United States Patent 12,312,412 (MAGEB2 BINDING CONSTRUCTS) - sequence listing, part 2

SEQ ID NO: 3361 - protein, 32 aa, Artificial Sequence
  Description of Artificial Sequence: Synthetic polypeptide
RVTMTTDTSTSTAYMELRSLRSDDTAVYYCAR

SEQ ID NO: 3362 - protein, 32 aa, Artificial Sequence
  Description of Artificial Sequence: Synthetic polypeptide
RGTMTTDTSTSTAYMELRSLRSDDTAVYYCAR

SEQ ID NO: 3363 - protein, 32 aa, Artificial Sequence; identical to SEQ ID NO: 1441
  Description of Artificial Sequence: Synthetic polypeptide

SEQ ID NO: 3364 - protein, 32 aa, Artificial Sequence; identical to SEQ ID NO: 1442
  Description of Artificial Sequence: Synthetic polypeptide

SEQ ID NO: 3365 - protein, 32 aa, Artificial Sequence; identical to SEQ ID NO: 1442
  Description of Artificial Sequence: Synthetic polypeptide

SEQ ID NO: 3366 - protein, 32 aa, Artificial Sequence; identical to SEQ ID NO: 1442
  Description of Artificial Sequence: Synthetic polypeptide

SEQ ID NO: 3367 - protein, 32 aa, Artificial Sequence; identical to SEQ ID NO: 1442
  Description of Artificial Sequence: Synthetic polypeptide

SEQ ID NO: 3368 - protein, 32 aa, Artificial Sequence; identical to SEQ ID NO: 1442
  Description of Artificial Sequence: Synthetic polypeptide

SEQ ID NO: 3369 - protein, 32 aa, Artificial Sequence; identical to SEQ ID NO: 1442
  Description of Artificial Sequence: Synthetic polypeptide

SEQ ID NO: 3370 - protein, 32 aa, Artificial Sequence; identical to SEQ ID NO: 1442
  Description of Artificial Sequence: Synthetic polypeptide

SEQ ID NO: 3371 - protein, 32 aa, Artificial Sequence; identical to SEQ ID NO: 1442
  Description of Artificial Sequence: Synthetic polypeptide

SEQ ID NO: 3372 - protein, 32 aa, Artificial Sequence; identical to SEQ ID NO: 1442
  Description of Artificial Sequence: Synthetic polypeptide

SEQ ID NO: 3373 - protein, 32 aa, Artificial Sequence; identical to SEQ ID NO: 1480
  Description of Artificial Sequence: Synthetic polypeptide

SEQ ID NO: 3374 - protein, 32 aa, Artificial Sequence; identical to SEQ ID NO: 1480
  Description of Artificial Sequence: Synthetic polypeptide

SEQ ID NO: 3375 - protein, 32 aa, Artificial Sequence; identical to SEQ ID NO: 1499
  Description of Artificial Sequence: Synthetic polypeptide

SEQ ID NO: 3376 - protein, 32 aa, Artificial Sequence; identical to SEQ ID NO: 1499
  Description of Artificial Sequence: Synthetic polypeptide

SEQ ID NO: 3377 - protein, 32 aa, Artificial Sequence; identical to SEQ ID NO: 1490
  Description of Artificial Sequence: Synthetic polypeptide

SEQ ID NO: 3378 - protein, 32 aa, Artificial Sequence; identical to SEQ ID NO: 1479
  Description of Artificial Sequence: Synthetic polypeptide

SEQ ID NO: 3379 - protein, 32 aa, Artificial Sequence; identical to SEQ ID NO: 1499
  Description of Artificial Sequence: Synthetic polypeptide

SEQ ID NO: 3380 - protein, 32 aa, Artificial Sequence; identical to SEQ ID NO: 1507
  Description of Artificial Sequence: Synthetic polypeptide

SEQ ID NO: 3381 - protein, 32 aa, Artificial Sequence; identical to SEQ ID NO: 1427
  Description of Artificial Sequence: Synthetic polypeptide

SEQ ID NO: 3382 - protein, 32 aa, Artificial Sequence; identical to SEQ ID NO: 1428
  Description of Artificial Sequence: Synthetic polypeptide

SEQ ID NO: 3383 - protein, 32 aa, Artificial Sequence; identical to SEQ ID NO: 1427
  Description of Artificial Sequence: Synthetic polypeptide

SEQ ID NO: 3384 - protein, 32 aa, Artificial Sequence; identical to SEQ ID NO: 1427
  Description of Artificial Sequence: Synthetic polypeptide

SEQ ID NO: 3385 - protein, 32 aa, Artificial Sequence; identical to SEQ ID NO: 1501
  Description of Artificial Sequence: Synthetic polypeptide

SEQ ID NO: 3386 - protein, 32 aa, Artificial Sequence
  Description of Artificial Sequence: Synthetic polypeptide
RFTISRDDSKNTLYLQMNSLRAEDTAVYYCAR

SEQ ID NO: 3387 - protein, 32 aa, Artificial Sequence; identical to SEQ ID NO: 1504
  Description of Artificial Sequence: Synthetic polypeptide

SEQ ID NO: 3388 - protein, 32 aa, Artificial Sequence; identical to SEQ ID NO: 1505
  Description of Artificial Sequence: Synthetic polypeptide

SEQ ID NO: 3389 - protein, 9 aa, Artificial Sequence
  Description of Artificial Sequence: Synthetic peptide
QKYNSAPYT

SEQ ID NO: 3390 - protein, 9 aa, Artificial Sequence
  Description of Artificial Sequence: Synthetic peptide
QKYNSAPFT

SEQ ID NO: 3391 - protein, 9 aa, Artificial Sequence
  Description of Artificial Sequence: Synthetic peptide
QQSYSTPWT

SEQ ID NO: 3392 - protein, 9 aa, Artificial Sequence
  Description of Artificial Sequence: Synthetic peptide
QQSYSSPFT

SEQ ID NO: 3393 - protein, 9 aa, Artificial Sequence
  Description of Artificial Sequence: Synthetic peptide
QQSYSTPFT

SEQ ID NO: 3394 - protein, 9 aa, Artificial Sequence
  Description of Artificial Sequence: Synthetic peptide
QQYYSTPLT

SEQ ID NO: 3395 - protein, 9 aa, Artificial Sequence
  Description of Artificial Sequence: Synthetic peptide
QQYYSTPLT

SEQ ID NO: 3396 - protein, 9 aa, Artificial Sequence
  Description of Artificial Sequence: Synthetic peptide
MQRIEFPWT

SEQ ID NO: 3397 - protein, 9 aa, Artificial Sequence
  Description of Artificial Sequence: Synthetic peptide
MQALQTPWT

SEQ ID NO: 3398 - protein, 9 aa, Artificial Sequence
  Description of Artificial Sequence: Synthetic peptide
QQSYSTPLT

SEQ ID NO: 3399 - protein, 9 aa, Artificial Sequence
  Description of Artificial Sequence: Synthetic peptide
QQSYSIPLT

SEQ ID NO: 3400 - protein, 9 aa, Artificial Sequence
  Description of Artificial Sequence: Synthetic peptide
QKYNSAPWT

SEQ ID NO: 3401 - protein, 9 aa, Artificial Sequence
  Description of Artificial Sequence: Synthetic peptide
QKYNSAPFT

SEQ ID NO: 3402 - protein, 10 aa, Artificial Sequence
  Description of Artificial Sequence: Synthetic peptide
LLYYGGAQWV

SEQ ID NO: 3403 - protein, 9 aa, Artificial Sequence
  Description of Artificial Sequence: Synthetic peptide
VLWYSNRWV

SEQ ID NO: 3404 - protein, 9 aa, Artificial Sequence
  Description of Artificial Sequence: Synthetic peptide
VLWYSNRWV

SEQ ID NO: 3405 - protein, 9 aa, Artificial Sequence
  Description of Artificial Sequence: Synthetic peptide
VLWYSNRWV

SEQ ID NO: 3406 - protein, 9 aa, Artificial Sequence
  Description of Artificial Sequence: Synthetic peptide
VLWYSNRWV

SEQ ID NO: 3407 - protein, 9 aa, Artificial Sequence
  Description of Artificial Sequence: Synthetic peptide
VLWYSNRWV

SEQ ID NO: 3408 - protein, 9 aa, Artificial Sequence
  Description of Artificial Sequence: Synthetic peptide
VLWYSNRWV

SEQ ID NO: 3409 - protein, 9 aa, Artificial Sequence
  Description of Artificial Sequence: Synthetic peptide
VLWYSNRWV

SEQ ID NO: 3410 - protein, 9 aa, Artificial Sequence
  Description of Artificial Sequence: Synthetic peptide
VLWYSNRWV

SEQ ID NO: 3411 - protein, 9 aa, Artificial Sequence
  Description of Artificial Sequence: Synthetic peptide
VLWYSNRWV

SEQ ID NO: 3412 - protein, 11 aa, Artificial Sequence
  Description of Artificial Sequence: Synthetic peptide
QVWDSSSDHVV

SEQ ID NO: 3413 - protein, 11 aa, Artificial Sequence
  Description of Artificial Sequence: Synthetic peptide
QVWDSSSDHVV

SEQ ID NO: 3414 - protein, 12 aa, Artificial Sequence
  Description of Artificial Sequence: Synthetic peptide
QVWDSSSDHHVV

SEQ ID NO: 3415 - protein, 10 aa, Artificial Sequence
  Description of Artificial Sequence: Synthetic peptide
GIAAAGYFDY

SEQ ID NO: 3416 - protein, 7 aa, Artificial Sequence
  Description of Artificial Sequence: Synthetic peptide
GRATFDY

SEQ ID NO: 3417 - protein, 13 aa, Artificial Sequence
  Description of Artificial Sequence: Synthetic peptide
ITIFGVVIIYFDY

SEQ ID NO: 3418 - protein, 14 aa, Artificial Sequence
  Description of Artificial Sequence: Synthetic peptide
HGNFGNSYISYWAY

SEQ ID NO: 3419 - protein, 14 aa, Artificial Sequence
  Description of Artificial Sequence: Synthetic peptide
HGNFGNSYISYWAY

SEQ ID NO: 3420 - protein, 14 aa, Artificial Sequence
  Description of Artificial Sequence: Synthetic peptide
HGNFGNSYISYWAY

SEQ ID NO: 3421 - protein, 14 aa, Artificial Sequence
  Description of Artificial Sequence: Synthetic peptide
HGNFGNSYISYWAY

SEQ ID NO: 3422 - protein, 14 aa, Artificial Sequence
  Description of Artificial Sequence: Synthetic peptide
HGNFGNSYISYWAY

SEQ ID NO: 3423 - protein, 14 aa, Artificial Sequence
  Description of Artificial Sequence: Synthetic peptide
HGNFGNSYISYWAY

SEQ ID NO: 3424 - protein, 14 aa, Artificial Sequence
  Description of Artificial Sequence: Synthetic peptide
HGNFGNSYISYWAY

SEQ ID NO: 3425 - protein, 14 aa, Artificial Sequence
  Description of Artificial Sequence: Synthetic peptide
HGNFGNSYISYWAY

SEQ ID NO: 3426 - protein, 14 aa, Artificial Sequence
  Description of Artificial Sequence: Synthetic peptide
HGNFGNSYISYWAY

SEQ ID NO: 3427 - protein, 19 aa, Artificial Sequence
  Description of Artificial Sequence: Synthetic peptide
YYYGSGSYYNYYYYYGMDV

SEQ ID NO: 3428 - protein, 16 aa, Artificial Sequence
  Description of Artificial Sequence: Synthetic peptide
PSYSGSYYNYFSVMDV

SEQ ID NO: 3429 - protein, 13 aa, Artificial Sequence
  Description of Artificial Sequence: Synthetic peptide
ITIFGVVIIYFDY

SEQ ID NO: 3430 - protein, 11 aa, Artificial Sequence
  Description of Artificial Sequence: Synthetic peptide
GIFGVITYFDY

SEQ ID NO: 3431 - protein, 8 aa, Artificial Sequence
  Description of Artificial Sequence: Synthetic peptide
LLLNWFDP

SEQ ID NO: 3432 - protein, 13 aa, Artificial Sequence
  Description of Artificial Sequence: Synthetic peptide
RRYNWNYENWFDP

SEQ ID NO: 3433 - protein, 18 aa, Artificial Sequence
  Description of Artificial Sequence: Synthetic peptide
ITMVRGVIIYYYYYGMDV

SEQ ID NO: 3434 - protein, 16 aa, Artificial Sequence
  Description of Artificial Sequence: Synthetic peptide
EKMWFGVLNYYYGMDV

SEQ ID NO: 3435 - protein, 10 aa, Artificial Sequence
  Description of Artificial Sequence: Synthetic peptide
GIAVAGYFDY

SEQ ID NO: 3436 - protein, 10 aa, Artificial Sequence
  Description of Artificial Sequence: Synthetic peptide
GKGVHLGFDY

SEQ ID NO: 3437 - protein, 16 aa, Artificial Sequence
  Description of Artificial Sequence: Synthetic peptide
GYSSGWYYYYYYGMDV

SEQ ID NO: 3438 - protein, 17 aa, Artificial Sequence
  Description of Artificial Sequence: Synthetic peptide
DGGSGWFPKLLHYGLDV

SEQ ID NO: 3439 - protein, 9 aa, Artificial Sequence
  Description of Artificial Sequence: Synthetic peptide
VQLERYFDY

SEQ ID NO: 3440 - protein, 7 aa, Artificial Sequence
  Description of Artificial Sequence: Synthetic peptide
GQLLTGY

SEQ ID NO: 3441 - protein, 9 aa, Artificial Sequence
  Description of Artificial Sequence: Synthetic peptide
YNWNDYFDY

SEQ ID NO: 3442 - protein, 8 aa, Artificial Sequence
  Description of Artificial Sequence: Synthetic peptide
YNYGHFDY

SEQ ID NO: 3443 - protein, 10 aa, Artificial Sequence
  Description of Artificial Sequence: Synthetic peptide
FGQGTKLEIK

SEQ ID NO: 3444 - protein, 10 aa, Artificial Sequence
  Description of Artificial Sequence: Synthetic peptide
FGCGTKLEIK

SEQ ID NO: 3445 - protein, 10 aa, Artificial Sequence
  Description of Artificial Sequence: Synthetic peptide
FGQGTKVEIK

SEQ ID NO: 3446 - protein, 10 aa, Artificial Sequence
  Description of Artificial Sequence: Synthetic peptide
FGCGTKVEIK

SEQ ID NO: 3447 - protein, 10 aa, Artificial Sequence
  Description of Artificial Sequence: Synthetic peptide
FGCGTKVEIK

SEQ ID NO: 3448 - protein, 10 aa, Artificial Sequence
  Description of Artificial Sequence: Synthetic peptide
FGGGTKVEIK

SEQ ID NO: 3449 - protein, 10 aa, Artificial Sequence
  Description of Artificial Sequence: Synthetic peptide
FGCGTKVEIK

SEQ ID NO: 3450 - protein, 10 aa, Artificial Sequence
  Description of Artificial Sequence: Synthetic peptide
FGQGTKVEIK

SEQ ID NO: 3451 - protein, 10 aa, Artificial Sequence
  Description of Artificial Sequence: Synthetic peptide
FGCGTKVEIK

SEQ ID NO: 3452 - protein, 10 aa, Artificial Sequence
  Description of Artificial Sequence: Synthetic peptide
FGGGTKVEIK

SEQ ID NO: 3453 - protein, 10 aa, Artificial Sequence
  Description of Artificial Sequence: Synthetic peptide
FGCGTKVEIK

SEQ ID NO: 3454 - protein, 10 aa, Artificial Sequence
  Description of Artificial Sequence: Synthetic peptide
FGQGTKVEIK

SEQ ID NO: 3455 - protein, 10 aa, Artificial Sequence
  Description of Artificial Sequence: Synthetic peptide
FGCGTKVEIK

SEQ ID NO: 3456 - protein, 10 aa, Artificial Sequence
  Description of Artificial Sequence: Synthetic peptide
FGGGTKLTVL

SEQ ID NO: 3457 - protein, 10 aa, Artificial Sequence
  Description of Artificial Sequence: Synthetic peptide
FGGGTKLTVL

SEQ ID NO: 3458 - protein, 10 aa, Artificial Sequence
  Description of Artificial Sequence: Synthetic peptide
FGGGTKLTVL

SEQ ID NO: 3459 - protein, 10 aa, Artificial Sequence
  Description of Artificial Sequence: Synthetic peptide
FGGGTKLTVL

SEQ ID NO: 3460 - protein, 10 aa, Artificial Sequence
  Description of Artificial Sequence: Synthetic peptide
FGGGTKLTVL

SEQ ID NO: 3461 - protein, 10 aa, Artificial Sequence
  Description of Artificial Sequence: Synthetic peptide
FGGGTKLTVL

SEQ ID NO: 3462 - protein, 10 aa, Artificial Sequence
  Description of Artificial Sequence: Synthetic peptide
FGGGTKLTVL

SEQ ID NO: 3463 - protein, 10 aa, Artificial Sequence
  Description of Artificial Sequence: Synthetic peptide
FGGGTKLTVL

SEQ ID NO: 3464 - protein, 10 aa, Artificial Sequence
  Description of Artificial Sequence: Synthetic peptide
FGGGTKLTVL

SEQ ID NO: 3465 - protein, 10 aa, Artificial Sequence
  Description of Artificial Sequence: Synthetic peptide
FGGGTKLTVL

SEQ ID NO: 3466 - protein, 10 aa, Artificial Sequence
  Description of Artificial Sequence: Synthetic peptide
FGGGTKLTVL

SEQ ID NO: 3467 - protein, 10 aa, Artificial Sequence
  Description of Artificial Sequence: Synthetic peptide
FGCGTKLTVL

SEQ ID NO: 3468 - protein, 10 aa, Artificial Sequence
  Description of Artificial Sequence: Synthetic peptide
FGCGTKLTVS

SEQ ID NO: 3469 - protein, 11 aa, Artificial Sequence
  Description of Artificial Sequence: Synthetic peptide
WGQGTLVTVSS

SEQ ID NO: 3470 - protein, 11 aa, Artificial Sequence
  Description of Artificial Sequence: Synthetic peptide
WGQGTLVTVSS

SEQ ID NO: 3471 - protein, 11 aa, Artificial Sequence
  Description of Artificial Sequence: Synthetic peptide
WGQGTLVTVSS

SEQ ID NO: 3472 - protein, 11 aa, Artificial Sequence
  Description of Artificial Sequence: Synthetic peptide
WGQGTLVTVSS

SEQ ID NO: 3473 - protein, 11 aa, Artificial Sequence
  Description of Artificial Sequence: Synthetic peptide
WGQGTLVTVSS

SEQ ID NO: 3474 - protein, 11 aa, Artificial Sequence
  Description of Artificial Sequence: Synthetic peptide
WGQGTLVTVSS

SEQ ID NO: 3475 - protein, 11 aa, Artificial Sequence
  Description of Artificial Sequence: Synthetic peptide
WGQGTLVTVSS

SEQ ID NO: 3476 - protein, 11 aa, Artificial Sequence
  Description of Artificial Sequence: Synthetic peptide
WGQGTLVTVSS

SEQ ID NO: 3477 - protein, 11 aa, Artificial Sequence
  Description of Artificial Sequence: Synthetic peptide
WGQGTLVTVSS

SEQ ID NO: 3478 - protein, 11 aa, Artificial Sequence
  Description of Artificial Sequence: Synthetic peptide
WGQGTLVTVSS

SEQ ID NO: 3479 - protein, 11 aa, Artificial Sequence
  Description of Artificial Sequence: Synthetic peptide
WGQGTLVTVSS

SEQ ID NO: 3480 - protein, 11 aa, Artificial Sequence
  Description of Artificial Sequence: Synthetic peptide
WGQGTLVTVSS

SEQ ID NO: 3481 - protein, 11 aa, Artificial Sequence
  Description of Artificial Sequence: Synthetic peptide
WGQGTTVTVSS

SEQ ID NO: 3482 - protein, 11 aa, Artificial Sequence
  Description of Artificial Sequence: Synthetic peptide
WGQGTTVTVSS

SEQ ID NO: 3483 - protein, 11 aa, Artificial Sequence
  Description of Artificial Sequence: Synthetic peptide
WGQGTLVTVSS

SEQ ID NO: 3484 - protein, 11 aa, Artificial Sequence
  Description of Artificial Sequence: Synthetic peptide
WGQGTLVTVSS

SEQ ID NO: 3485 - protein, 11 aa, Artificial Sequence
  Description of Artificial Sequence: Synthetic peptide
WGQGTLVTVSS

SEQ ID NO: 3486 - protein, 11 aa, Artificial Sequence
  Description of Artificial Sequence: Synthetic peptide
WGQGTLVTVSS

SEQ ID NO: 3487 - protein, 11 aa, Artificial Sequence
  Description of Artificial Sequence: Synthetic peptide
WGQGTTVTVSS

SEQ ID NO: 3488 - protein, 11 aa, Artificial Sequence
  Description of Artificial Sequence: Synthetic peptide
WGQGTTVTVSS

SEQ ID NO: 3489 - protein, 11 aa, Artificial Sequence
  Description of Artificial Sequence: Synthetic peptide
WGQGTLVTVSS

SEQ ID NO: 3490 - protein, 11 aa, Artificial Sequence
  Description of Artificial Sequence: Synthetic peptide
WGQGTLVTVSS

SEQ ID NO: 3491 - protein, 11 aa, Artificial Sequence
  Description of Artificial Sequence: Synthetic peptide
WGQGTTVTVSS

SEQ ID NO: 3492 - protein, 11 aa, Artificial Sequence
  Description of Artificial Sequence: Synthetic peptide
WGQGTTVTVSS

SEQ ID NO: 3493 - protein, 11 aa, Artificial Sequence
  Description of Artificial Sequence: Synthetic peptide
WGQGTLVTVSS

SEQ ID NO: 3494 - protein, 11 aa, Artificial Sequence
  Description of Artificial Sequence: Synthetic peptide
WGQGTLVTVSS

SEQ ID NO: 3495 - protein, 11 aa, Artificial Sequence
  Description of Artificial Sequence: Synthetic peptide
WGQGTLVTVSS

SEQ ID NO: 3496 - protein, 11 aa, Artificial Sequence
  Description of Artificial Sequence: Synthetic peptide
WGQGTLVTVSS

SEQ ID NO: 3497 - protein, 23 aa, Artificial Sequence
  Description of Artificial Sequence: Synthetic peptide
DIQMTQSPSSLSASVGDRVTITC

SEQ ID NO: 3498 - protein, 23 aa, Artificial Sequence
  Description of Artificial Sequence: Synthetic peptide
ELVMTQSPSSLSASVGDRVTITC

SEQ ID NO: 3499 - protein, 23 aa, Artificial Sequence
  Description of Artificial Sequence: Synthetic peptide
DIQMTQSPSSLSASVGDRVTITC

SEQ ID NO: 3500 - protein, 23 aa, Artificial Sequence
  Description of Artificial Sequence: Synthetic peptide
ELQMTQSPSSLSASVGDRVTITC

SEQ ID NO: 3501 - protein, 23 aa, Artificial Sequence
  Description of Artificial Sequence: Synthetic peptide
ELQMTQSPSSLSASVGDRVTITC

SEQ ID NO: 3502 - protein, 23 aa, Artificial Sequence
  Description of Artificial Sequence: Synthetic peptide
DIVMTQSPDSLAVSLGERATINC

SEQ ID NO: 3503 - protein, 23 aa, Artificial Sequence
  Description of Artificial Sequence: Synthetic peptide
ELVMTQTPDSLAVSLGERATINC

SEQ ID NO: 3504 - protein, 23 aa, Artificial Sequence
  Description of Artificial Sequence: Synthetic peptide
DIVMTQTPLSLPVTPGEPASISC

SEQ ID NO: 3505 - protein, 23 aa, Artificial Sequence
  Description of Artificial Sequence: Synthetic peptide
ELVMTQTPLSLPVTPGEPASISC

SEQ ID NO: 3506 - protein, 23 aa, Artificial Sequence
  Description of Artificial Sequence: Synthetic peptide
DIQMTQSPSSLSASVGDRVTITC

SEQ ID NO: 3507 - protein, 23 aa, Artificial Sequence
  Description of Artificial Sequence: Synthetic peptide
ELQMTQSPSSLSASVGDRVTITC

SEQ ID NO: 3508 - protein, 23 aa, Artificial Sequence
  Description of Artificial Sequence: Synthetic peptide
DIQMTQSPSSLSASVGDRVTITC

SEQ ID NO: 3509 - protein, 23 aa, Artificial Sequence
  Description of Artificial Sequence: Synthetic peptide
ELVMTQSPSSLSASVGDRVTITC

SEQ ID NO: 3510 - protein, 22 aa, Artificial Sequence
  Description of Artificial Sequence: Synthetic peptide
QTVVTQEPSLTVSPGGTVTLTC

SEQ ID NO: 3511 - protein, 22 aa, Artificial Sequence
  Description of Artificial Sequence: Synthetic peptide
QTVVTQEPSLTVSPGGTVTLTC

SEQ ID NO: 3512 - protein, 22 aa, Artificial Sequence
  Description of Artificial Sequence: Synthetic peptide
QTVVTQEPSLTVSPGGTVTLTC

SEQ ID NO: 3513 - protein, 22 aa, Artificial Sequence
  Description of Artificial Sequence: Synthetic peptide
QTVVTQEPSLTVSPGGTVTLTC

SEQ ID NO: 3514 - protein, 22 aa, Artificial Sequence
  Description of Artificial Sequence: Synthetic peptide
QTVVTQEPSLTVSPGGTVTLTC

SEQ ID NO: 3515 - protein, 22 aa, Artificial Sequence
  Description of Artificial Sequence: Synthetic peptide
QTVVTQEPSLTVSPGGTVTLTC

SEQ ID NO: 3516 - protein, 22 aa, Artificial Sequence
  Description of Artificial Sequence: Synthetic peptide
QTVVTQEPSLTVSPGGTVTLTC

SEQ ID NO: 3517 - protein, 22 aa, Artificial Sequence
  Description of Artificial Sequence: Synthetic peptide
QTVVTQEPSLTVSPGGTVTLTC

SEQ ID NO: 3518 - protein, 22 aa, Artificial Sequence
  Description of Artificial Sequence: Synthetic peptide
QTVVTQEPSLTVSPGGTVTLTC

SEQ ID NO: 3519 - protein, 22 aa, Artificial Sequence
  Description of Artificial Sequence: Synthetic peptide
QTVVTQEPSLTVSPGGTVTLTC

SEQ ID NO: 3520 - protein, 22 aa, Artificial Sequence
  Description of Artificial Sequence: Synthetic peptide
SYVLTQPPSVSVAPGKTARITC

SEQ ID NO: 3521 - protein, 22 aa, Artificial Sequence
  Description of Artificial Sequence: Synthetic peptide
ELVLTQPPSVSVAPGQTARITC

SEQ ID NO: 3522 - protein, 22 aa, Artificial Sequence
  Description of Artificial Sequence: Synthetic peptide
ELVLTQPPSVSVAPGQTARITC

SEQ ID NO: 3523 - protein, 30 aa, Artificial Sequence; identical to SEQ ID NO: 3145
  Description of Artificial Sequence: Synthetic polypeptide

SEQ ID NO: 3524 - protein, 30 aa, Artificial Sequence; identical to SEQ ID NO: 3146
  Description of Artificial Sequence: Synthetic polypeptide

SEQ ID NO: 3525 - protein, 30 aa, Artificial Sequence; identical to SEQ ID NO: 793
  Description of Artificial Sequence: Synthetic polypeptide

SEQ ID NO: 3526 - protein, 30 aa, Artificial Sequence; identical to SEQ ID NO: 794
  Description of Artificial Sequence: Synthetic polypeptide

SEQ ID NO: 3527 - protein, 30 aa, Artificial Sequence; identical to SEQ ID NO: 794
  Description of Artificial Sequence: Synthetic polypeptide

SEQ ID NO: 3528 - protein, 30 aa, Artificial Sequence; identical to SEQ ID NO: 794
  Description of Artificial Sequence: Synthetic polypeptide

SEQ ID NO: 3529 - protein, 30 aa, Artificial Sequence; identical to SEQ ID NO: 794
  Description of Artificial Sequence: Synthetic polypeptide

SEQ ID NO: 3530 - protein, 30 aa, Artificial Sequence; identical to SEQ ID NO: 794
  Description of Artificial Sequence: Synthetic polypeptide

SEQ ID NO: 3531 - protein, 30 aa, Artificial Sequence; identical to SEQ ID NO: 794
  Description of Artificial Sequence: Synthetic polypeptide

SEQ ID NO: 3532 - protein, 30 aa, Artificial Sequence; identical to SEQ ID NO: 794
  Description of Artificial Sequence: Synthetic polypeptide

SEQ ID NO: 3533 - protein, 30 aa, Artificial Sequence; identical to SEQ ID NO: 794
  Description of Artificial Sequence: Synthetic polypeptide

SEQ ID NO: 3534 - protein, 30 aa, Artificial Sequence; identical to SEQ ID NO: 794
  Description of Artificial Sequence: Synthetic polypeptide

SEQ ID NO: 3535 - protein, 30 aa, Artificial Sequence; identical to SEQ ID NO: 832
  Description of Artificial Sequence: Synthetic polypeptide

SEQ ID NO: 3536 - protein, 30 aa, Artificial Sequence; identical to SEQ ID NO: 779
  Description of Artificial Sequence: Synthetic polypeptide

SEQ ID NO: 3537 - protein, 30 aa, Artificial Sequence; identical to SEQ ID NO: 851
  Description of Artificial Sequence: Synthetic polypeptide

SEQ ID NO: 3538 - protein, 30 aa, Artificial Sequence; identical to SEQ ID NO: 3160
  Description of Artificial Sequence: Synthetic polypeptide

SEQ ID NO: 3539 - protein, 30 aa, Artificial Sequence; identical to SEQ ID NO: 842
  Description of Artificial Sequence: Synthetic polypeptide

SEQ ID NO: 3540 - protein, 30 aa, Artificial Sequence; identical to SEQ ID NO: 3162
  Description of Artificial Sequence: Synthetic polypeptide

SEQ ID NO: 3541 - protein, 30 aa, Artificial Sequence; identical to SEQ ID NO: 858
  Description of Artificial Sequence: Synthetic polypeptide

SEQ ID NO: 3542 - protein, 30 aa, Artificial Sequence; identical to SEQ ID NO: 3164
  Description of Artificial Sequence: Synthetic polypeptide

SEQ ID NO: 3543 - protein, 30 aa, Artificial Sequence; identical to SEQ ID NO: 779
  Description of Artificial Sequence: Synthetic polypeptide

SEQ ID NO: 3544 - protein, 30 aa, Artificial Sequence; identical to SEQ ID NO: 779
  Description of Artificial Sequence: Synthetic polypeptide

SEQ ID NO: 3545 - protein, 30 aa, Artificial Sequence; identical to SEQ ID NO: 779
  Description of Artificial Sequence: Synthetic polypeptide

SEQ ID NO: 3546 - protein, 30 aa, Artificial Sequence; identical to SEQ ID NO: 779
  Description of Artificial Sequence: Synthetic polypeptide

SEQ ID NO: 3547 - protein, 30 aa, Artificial Sequence; identical to SEQ ID NO: 853
  Description of Artificial Sequence: Synthetic polypeptide

SEQ ID NO: 3548 - protein, 30 aa, Artificial Sequence; identical to SEQ ID NO: 784
  Description of Artificial Sequence: Synthetic polypeptide

SEQ ID NO: 3549 - protein, 30 aa, Artificial Sequence; identical to SEQ ID NO: 856
  Description of Artificial Sequence: Synthetic polypeptide

SEQ ID NO: 3550 - protein, 30 aa, Artificial Sequence; identical to SEQ ID NO: 787
  Description of Artificial Sequence: Synthetic polypeptide

SEQ ID NO: 3551 - protein, 11 aa, Artificial Sequence
  Description of Artificial Sequence: Synthetic peptide
RASQGISNYLA

SEQ ID NO: 3552 - protein, 11 aa, Artificial Sequence
  Description of Artificial Sequence: Synthetic peptide
RASQGISNYLA

SEQ ID NO: 3553 - protein, 11 aa, Artificial Sequence
  Description of Artificial Sequence: Synthetic peptide
RASQSISSYLN

SEQ ID NO: 3554 - protein, 11 aa, Artificial Sequence
  Description of Artificial Sequence: Synthetic peptide
RTSQSISSYLN

SEQ ID NO: 3555 - protein, 11 aa, Artificial Sequence
  Description of Artificial Sequence: Synthetic peptide
RASQSISSYLN

SEQ ID NO: 3556 - protein, 17 aa, Artificial Sequence
  Description of Artificial Sequence: Synthetic peptide
KSSQSVLYSSNNKNYLA

SEQ ID NO: 3557 - protein, 17 aa, Artificial Sequence
  Description of Artificial Sequence: Synthetic peptide
KSSQSVLYSSNNKNYLA

SEQ ID NO: 3558 - protein, 17 aa, Artificial Sequence
  Description of Artificial Sequence: Synthetic peptide
RSSQSLLDSDDGNTYLD

SEQ ID NO: 3559 - protein, 16 aa, Artificial Sequence
  Description of Artificial Sequence: Synthetic peptide
RSSQSLLHRNGYNYLD

SEQ ID NO: 3560 - protein, 11 aa, Artificial Sequence
  Description of Artificial Sequence: Synthetic peptide
RASQSISSYLN

SEQ ID NO: 3561 - protein, 11 aa, Artificial Sequence
  Description of Artificial Sequence: Synthetic peptide
QASQDISNYLN

SEQ ID NO: 3562 - protein, 11 aa, Artificial Sequence
  Description of Artificial Sequence: Synthetic peptide
RASQGISNYLA

SEQ ID NO: 3563 - protein, 11 aa, Artificial Sequence
  Description of Artificial Sequence: Synthetic peptide
RASQGISNYLA

SEQ ID NO: 3564 - protein, 14 aa, Artificial Sequence
  Description of Artificial Sequence: Synthetic peptide
ASSTGAVTSGYYPN

SEQ ID NO: 3565 - protein, 14 aa, Artificial Sequence
  Description of Artificial Sequence: Synthetic peptide
GSSTGAVTSGNYPN

SEQ ID NO: 3566 - protein, 14 aa, Artificial Sequence
  Description of Artificial Sequence: Synthetic peptide
GSSTGAVTSGNYPN

SEQ ID NO: 3567 - protein, 14 aa, Artificial Sequence
  Description of Artificial Sequence: Synthetic peptide
GSSTGAVTSGNYPN

SEQ ID NO: 3568 - protein, 14 aa, Artificial Sequence
  Description of Artificial Sequence: Synthetic peptide
GSSTGAVTSGNYPN

SEQ ID NO: 3569 - protein, 14 aa, Artificial Sequence
  Description of Artificial Sequence: Synthetic peptide
GSSTGAVTSGNYPN

SEQ ID NO: 3570 - protein, 14 aa, Artificial Sequence
  Description of Artificial Sequence: Synthetic peptide
GSSTGAVTSGNYPN

SEQ ID NO: 3571 - protein, 14 aa, Artificial Sequence
  Description of Artificial Sequence: Synthetic peptide
GSSTGAVTSGNYPN

SEQ ID NO: 3572 - protein, 14 aa, Artificial Sequence
  Description of Artificial Sequence: Synthetic peptide
GSSTGAVTSGNYPN

SEQ ID NO: 3573 - protein, 14 aa, Artificial Sequence
  Description of Artificial Sequence: Synthetic peptide
GSSTGAVTSGNYPN

SEQ ID NO: 3574 - protein, 11 aa, Artificial Sequence
  Description of Artificial Sequence: Synthetic peptide
GGNNIGSKSVH

SEQ ID NO: 3575 - protein, 11 aa, Artificial Sequence
  Description of Artificial Sequence: Synthetic peptide
GGNNIGSKSVH

SEQ ID NO: 3576 - protein, 11 aa, Artificial Sequence
  Description of Artificial Sequence: Synthetic peptide
GGNNIGSKSVH

SEQ ID NO: 3577 - protein, 5 aa, Artificial Sequence
  Description of Artificial Sequence: Synthetic peptide
SYGIS

SEQ ID NO: 3578 - protein, 5 aa, Artificial Sequence
  Description of Artificial Sequence: Synthetic peptide
RNGLS

SEQ ID NO: 3579 - protein, 5 aa, Artificial Sequence
  Description of Artificial Sequence: Synthetic peptide
GSAMH

SEQ ID NO: 3580 - protein, 5 aa, Artificial Sequence
  Description of Artificial Sequence: Synthetic peptide
KYAMN

SEQ ID NO: 3581 - protein, 5 aa, Artificial Sequence
  Description of Artificial Sequence: Synthetic peptide
KYAMN

SEQ ID NO: 3582 - protein, 5 aa, Artificial Sequence
  Description of Artificial Sequence: Synthetic peptide
KYAMN

SEQ ID NO: 3583 - protein, 5 aa, Artificial Sequence
  Description of Artificial Sequence: Synthetic peptide
KYAMN

SEQ ID NO: 3584 - protein, 5 aa, Artificial Sequence
  Description of Artificial Sequence: Synthetic peptide
KYAMN

SEQ ID NO: 3585 - protein, 5 aa, Artificial Sequence
  Description of Artificial Sequence: Synthetic peptide
KYAMN

SEQ ID NO: 3586 - protein, 5 aa, Artificial Sequence
  Description of Artificial Sequence: Synthetic peptide
KYAMN

SEQ ID NO: 3587 - protein, 5 aa, Artificial Sequence
  Description of Artificial Sequence: Synthetic peptide
KYAMN

SEQ ID NO: 3588 - protein, 5 aa, Artificial Sequence
  Description of Artificial Sequence: Synthetic peptide
KYAMN

SEQ ID NO: 3589 - protein, 5 aa, Artificial Sequence
  Description of Artificial Sequence: Synthetic peptide
NAWMS

SEQ ID NO: 3590 - protein, 5 aa, Artificial Sequence
  Description of Artificial Sequence: Synthetic peptide
NAWMS

SEQ ID NO: 3591 - protein, 5 aa, Artificial Sequence
  Description of Artificial Sequence: Synthetic peptide
SYYWS

SEQ ID NO: 3592 - protein, 7 aa, Artificial Sequence
  Description of Artificial Sequence: Synthetic peptide
SSRYYWG

SEQ ID NO: 3593 - protein, 7 aa, Artificial Sequence
  Description of Artificial Sequence: Synthetic peptide
TSGVGVG

SEQ ID NO: 3594 - protein, 7 aa, Artificial Sequence
  Description of Artificial Sequence: Synthetic peptide
THKMGVD

SEQ ID NO: 3595 - protein, 7 aa, Artificial Sequence
  Description of Artificial Sequence: Synthetic peptide
SGGYYWS

SEQ ID NO: 3596 - protein, 7 aa, Artificial Sequence
  Description of Artificial Sequence: Synthetic peptide
SNPYYWS

SEQ ID NO: 3597 - protein, 5 aa, Artificial Sequence
  Description of Artificial Sequence: Synthetic peptide
SYAMS

SEQ ID NO: 3598 - protein, 5 aa, Artificial Sequence
  Description of Artificial Sequence: Synthetic peptide
SHAMS

SEQ ID NO: 3599 - protein, 5 aa, Artificial Sequence
  Description of Artificial Sequence: Synthetic peptide
SYAMS

SEQ ID NO: 3600 - protein, 5 aa, Artificial Sequence
  Description of Artificial Sequence: Synthetic peptide
SYAMS

SEQ ID NO: 3601 - protein, 5 aa, Artificial Sequence
  Description of Artificial Sequence: Synthetic peptide
SYAMH

SEQ ID NO: 3602 - protein, 5 aa, Artificial Sequence
  Description of Artificial Sequence: Synthetic peptide
TYGMH

SEQ ID NO: 3603 - protein, 5 aa, Artificial Sequence
  Description of Artificial Sequence: Synthetic peptide
DYYMS

SEQ ID NO: 3604 - protein, 5 aa, Artificial Sequence
  Description of Artificial Sequence: Synthetic peptide
DYYMS

SEQ ID NO: 3605 - protein, 15 aa, Artificial Sequence
  Description of Artificial Sequence: Synthetic peptide
WYQQKPGKVPKLLIY

SEQ ID NO: 3606 - protein, 15 aa, Artificial Sequence
  Description of Artificial Sequence: Synthetic peptide
WYQQKPGKVPKLLIS

SEQ ID NO: 3607 - protein, 15 aa, Artificial Sequence
  Description of Artificial Sequence: Synthetic peptide
WYQQKPGKAPKLLIY

SEQ ID NO: 3608 - protein, 15 aa, Artificial Sequence
  Description of Artificial Sequence: Synthetic peptide
WFQQKPGKAPKLLIF

SEQ ID NO: 3609 - protein, 15 aa, Artificial Sequence
  Description of Artificial Sequence: Synthetic peptide
WYQQKPGKAPKLLIY

SEQ ID NO: 3610 - protein, 15 aa, Artificial Sequence
  Description of Artificial Sequence: Synthetic peptide
WYQQKPGQPPKLLIY

SEQ ID NO: 3611 - protein, 15 aa, Artificial Sequence
  Description of Artificial Sequence: Synthetic peptide
WYQQKPGQPPKLLIY

SEQ ID NO: 3612 - protein, 15 aa, Artificial Sequence
  Description of Artificial Sequence: Synthetic peptide
WYLQKPGQSPQLLIY

SEQ ID NO: 3613 - protein, 15 aa, Artificial Sequence
  Description of Artificial Sequence: Synthetic peptide
WYLQKPGQSPQLLIY

SEQ ID NO: 3614 - protein, 15 aa, Artificial Sequence
  Description of Artificial Sequence: Synthetic peptide
WYQQKPGKAPKLLIY

SEQ ID NO: 3615 - protein, 15 aa, Artificial Sequence
  Description of Artificial Sequence: Synthetic peptide
WYQQKPGKAPKLLIY

SEQ ID NO: 3616 - protein, 15 aa, Artificial Sequence
  Description of Artificial Sequence: Synthetic peptide
WYQQKPGKVPKLLIY

SEQ ID NO: 3617 - protein, 15 aa, Artificial Sequence
  Description of Artificial Sequence: Synthetic peptide
WYQQKPGKVPKLLIY

SEQ ID NO: 3618 - protein, 15 aa, Artificial Sequence
  Description of Artificial Sequence: Synthetic peptide
WFQQKPGQAPRALIY

SEQ ID NO: 3619 - protein, 15 aa, Artificial Sequence
  Description of Artificial Sequence: Synthetic peptide
WVQQKPGQAPRGLIG

SEQ ID NO: 3620 - protein, 15 aa, Artificial Sequence
  Description of Artificial Sequence: Synthetic peptide
WVQQKPGQAPRGLIG

SEQ ID NO: 3621 - protein, 15 aa, Artificial Sequence
  Description of Artificial Sequence: Synthetic peptide
WVQQKPGQAPRGLIG

SEQ ID NO: 3622 - protein, 15 aa, Artificial Sequence
  Description of Artificial Sequence: Synthetic peptide
WVQQKPGQAPRGLIG

SEQ ID NO: 3623 - protein, 15 aa, Artificial Sequence
  Description of Artificial Sequence: Synthetic peptide
WVQQKPGQAPRGLIG

SEQ ID NO: 3624 - protein, 15 aa, Artificial Sequence
  Description of Artificial Sequence: Synthetic peptide
WVQQKPGQAPRGLIG

SEQ ID NO: 3625 - protein, 15 aa, Artificial Sequence
  Description of Artificial Sequence: Synthetic peptide
WVQQKPGQAPRGLIG

SEQ ID NO: 3626 - protein, 15 aa, Artificial Sequence
  Description of Artificial Sequence: Synthetic peptide
WVQQKPGQAPRGLIG

SEQ ID NO: 3627 - protein, 15 aa, Artificial Sequence
  Description of Artificial Sequence: Synthetic peptide
WVQQKPGQAPRGLIG

SEQ ID NO: 3628 - protein, 15 aa, Artificial Sequence
  Description of Artificial Sequence: Synthetic peptide
WYQQKPGQAPVLVIY

SEQ ID NO: 3629 - protein, 15 aa, Artificial Sequence
  Description of Artificial Sequence: Synthetic peptide
WYQQKPGQAPVLVVY

SEQ ID NO: 3630 - protein, 15 aa, Artificial Sequence
  Description of Artificial Sequence: Synthetic peptide
WYQQKPGQAPVLVVY

SEQ ID NO: 3631 - protein, 14 aa, Artificial Sequence
  Description of Artificial Sequence: Synthetic peptide
WVRQAPGQGLEWMG

SEQ ID NO: 3632 - protein, 14 aa, Artificial Sequence
  Description of Artificial Sequence: Synthetic peptide
WVRQAPGQCLEWMG

SEQ ID NO: 3633 - protein, 14 aa, Artificial Sequence
  Description of Artificial Sequence: Synthetic peptide
WVRQASGKGLEWVG

SEQ ID NO: 3634 - protein, 14 aa, Artificial Sequence
  Description of Artificial Sequence: Synthetic peptide
WVRQAPGKGLEWVA

SEQ ID NO: 3635 - protein, 14 aa, Artificial Sequence
  Description of Artificial Sequence: Synthetic peptide
WVRQAPGKGLEWVA

SEQ ID NO: 3636 - protein, 14 aa, Artificial Sequence
  Description of Artificial Sequence: Synthetic peptide
WVRQAPGKGLEWVA

SEQ ID NO: 3637 - protein, 14 aa, Artificial Sequence
  Description of Artificial Sequence: Synthetic peptide
WVRQAPGKGLEWVA

SEQ ID NO: 3638 - protein, 14 aa, Artificial Sequence
  Description of Artificial Sequence: Synthetic peptide
WVRQAPGKGLEWVA

SEQ ID NO: 3639 - protein, 14 aa, Artificial Sequence
  Description of Artificial Sequence: Synthetic peptide
WVRQAPGKGLEWVA

SEQ ID NO: 3640 - protein, 14 aa, Artificial Sequence
  Description of Artificial Sequence: Synthetic peptide
WVRQAPGKGLEWVA

SEQ ID NO: 3641 - protein, 14 aa, Artificial Sequence
  Description of Artificial Sequence: Synthetic peptide
WVRQAPGKGLEWVA

SEQ ID NO: 3642 - protein, 14 aa, Artificial Sequence
  Description of Artificial Sequence: Synthetic peptide
WVRQAPGKGLEWVA

SEQ ID NO: 3643 - protein, 14 aa, Artificial Sequence
  Description of Artificial Sequence: Synthetic peptide
WVRQAPGKGLEWVG

SEQ ID NO: 3644 - protein, 14 aa, Artificial Sequence
  Description of Artificial Sequence: Synthetic peptide
WVRQAPGKCLEWVG

SEQ ID NO: 3645 - protein, 14 aa, Artificial Sequence
  Description of Artificial Sequence: Synthetic peptide
WIRQPPGKGLEWIG

SEQ ID NO: 3646 - protein, 14 aa, Artificial Sequence
  Description of Artificial Sequence: Synthetic peptide
WIRQPPGKCLEWIG

SEQ ID NO: 3647 - protein, 14 aa, Artificial Sequence
  Description of Artificial Sequence: Synthetic peptide
WIRQPPGKALEWLA

SEQ ID NO: 3648 - protein, 14 aa, Artificial Sequence
  Description of Artificial Sequence: Synthetic peptide
WIRQPPGKCLEWLA

SEQ ID NO: 3649 - protein, 14 aa, Artificial Sequence
  Description of Artificial Sequence: Synthetic peptide
WIRQHPGKGLEWIG

SEQ ID NO: 3650 - protein, 14 aa, Artificial Sequence
  Description of Artificial Sequence: Synthetic peptide
WIRQHPGKCLEWIG

SEQ ID NO: 3651 - protein, 14 aa, Artificial Sequence
  Description of Artificial Sequence: Synthetic peptide
WVRQAPGKGLEWVS

SEQ ID NO: 3652 - protein, 14 aa, Artificial Sequence
  Description of Artificial Sequence: Synthetic peptide
WVRQAPGKCLEWVS

SEQ ID NO: 3653 - protein, 14 aa, Artificial Sequence
  Description of Artificial Sequence: Synthetic peptide
WVRQAPGKGLEWVS

SEQ ID NO: 3654 - protein, 14 aa, Artificial Sequence
  Description of Artificial Sequence: Synthetic peptide
WVRQAPGRCLEWVS

SEQ ID NO: 3655 - protein, 14 aa, Artificial Sequence
  Description of Artificial Sequence: Synthetic peptide
WVRQAPGKGLEWVA

SEQ ID NO: 3656 - protein, 14 aa, Artificial Sequence
  Description of Artificial Sequence: Synthetic peptide
WVRQAPGKCLEWVA

SEQ ID NO: 3657 - protein, 14 aa, Artificial Sequence
  Description of Artificial Sequence: Synthetic peptide
WIRQAPGKGLEWVS

SEQ ID NO: 3658 - protein, 14 aa, Artificial Sequence
  Description of Artificial Sequence: Synthetic peptide
WIRQAPGKCLEWVS

SEQ ID NO: 3659 - protein, 7 aa, Artificial Sequence
  Description of Artificial Sequence: Synthetic peptide
AASTLQS

SEQ ID NO: 3660 - protein, 7 aa, Artificial Sequence
  Description of Artificial Sequence: Synthetic peptide
AASTLQS

SEQ ID NO: 3661 - protein, 7 aa, Artificial Sequence
  Description of Artificial Sequence: Synthetic peptide
AASSLQS

SEQ ID NO: 3662 - protein, 7 aa, Artificial Sequence
  Description of Artificial Sequence: Synthetic peptide
AASSLQS

SEQ ID NO: 3663 - protein, 7 aa, Artificial Sequence
  Description of Artificial Sequence: Synthetic peptide
AASSLQS

SEQ ID NO: 3664 - protein, 7 aa, Artificial Sequence
  Description of Artificial Sequence: Synthetic peptide
WASTRES

SEQ ID NO: 3665 - protein, 7 aa, Artificial Sequence
  Description of Artificial Sequence: Synthetic peptide
WASTRES

SEQ ID NO: 3666 - protein, 7 aa, Artificial Sequence
  Description of Artificial Sequence: Synthetic peptide
TLSYRAS

SEQ ID NO: 3667 - protein, 7 aa, Artificial Sequence
  Description of Artificial Sequence: Synthetic peptide
LGSNRAS

SEQ ID NO: 3668 - protein, 7 aa, Artificial Sequence
  Description of Artificial Sequence: Synthetic peptide
AASSLQS

SEQ ID NO: 3669 - protein, 7 aa, Artificial Sequence
  Description of Artificial Sequence: Synthetic peptide
AASSLQS

SEQ ID NO: 3670 - protein, 7 aa, Artificial Sequence
  Description of Artificial Sequence: Synthetic peptide
AASTLQS

SEQ ID NO: 3671 - protein, 7 aa, Artificial Sequence
  Description of Artificial Sequence: Synthetic peptide
AASTLQS

SEQ ID NO: 3672 - protein, 7 aa, Artificial Sequence
  Description of Artificial Sequence: Synthetic peptide
STSNKHS

SEQ ID NO: 3673 - protein, 7 aa, Artificial Sequence
  Description of Artificial Sequence: Synthetic peptide
GTKFLAP

SEQ ID NO: 3674 - protein, 7 aa, Artificial Sequence
  Description of Artificial Sequence: Synthetic peptide
GTKFLAP

SEQ ID NO: 3675 - protein, 7 aa, Artificial Sequence
  Description of Artificial Sequence: Synthetic peptide
GTKFLAP

SEQ ID NO: 3676 - protein, 7 aa, Artificial Sequence
  Description of Artificial Sequence: Synthetic peptide
GTKFLAP

SEQ ID NO: 3677 - protein, 7 aa, Artificial Sequence
  Description of Artificial Sequence: Synthetic peptide
GTKFLAP

SEQ ID NO: 3678 - protein, 7 aa, Artificial Sequence
  Description of Artificial Sequence: Synthetic peptide
GTKFLAP

SEQ ID NO: 3679 - protein, 7 aa, Artificial Sequence
  Description of Artificial Sequence: Synthetic peptide
GTKFLAP

SEQ ID NO: 3680 - protein, 7 aa, Artificial Sequence
  Description of Artificial Sequence: Synthetic peptide
GTKFLAP

SEQ ID NO: 3681 - protein, 7 aa, Artificial Sequence
  Description of Artificial Sequence: Synthetic peptide
GTKFLAP

SEQ ID NO: 3682 - protein, 7 aa, Artificial Sequence
  Description of Artificial Sequence: Synthetic peptide
YDSDRPS

SEQ ID NO: 3683 - protein, 7 aa, Artificial Sequence
  Description of Artificial Sequence: Synthetic peptide
DDNDRPS

SEQ ID NO: 3684 - protein, 7 aa, Artificial Sequence
  Description of Artificial Sequence: Synthetic peptide
DDSDRPS

SEQ ID NO: 3685 - protein, 17 aa, Artificial Sequence
  Description of Artificial Sequence: Synthetic peptide
WISAYNGNTNYAQKLQG

SEQ ID NO: 3686 - protein, 17 aa, Artificial Sequence
  Description of Artificial Sequence: Synthetic peptide
WISGYNGDTNYAQKLQG

SEQ ID NO: 3687 - protein, 19 aa, Artificial Sequence
  Description of Artificial Sequence: Synthetic peptide
RIRSKANSYATAYAASVKG

SEQ ID NO: 3688 - protein, 19 aa, Artificial Sequence
  Description of Artificial Sequence: Synthetic peptide
RIRSKYNNYATYYADSVKD

SEQ ID NO: 3689 - protein, 19 aa, Artificial Sequence
  Description of Artificial Sequence: Synthetic peptide
RIRSKYNNYATYYADSVKD

SEQ ID NO: 3690 - protein, 19 aa, Artificial Sequence
  Description of Artificial Sequence: Synthetic peptide
RIRSKYNNYATYYADSVKD

SEQ ID NO: 3691 - protein, 19 aa, Artificial Sequence
  Description of Artificial Sequence: Synthetic peptide
RIRSKYNNYATYYADSVKD

SEQ ID NO: 3692 - protein, 19 aa, Artificial Sequence
  Description of Artificial Sequence: Synthetic peptide
RIRSKYNNYATYYADSVKD

SEQ ID NO: 3693 - protein, 19 aa, Artificial Sequence
  Description of Artificial Sequence: Synthetic peptide
RIRSKYNNYATYYADSVKD

SEQ ID NO: 3694 - protein, 19 aa, Artificial Sequence
  Description of Artificial Sequence: Synthetic peptide
RIRSKYNNYATYYADSVKD

SEQ ID NO: 3695 - protein, 19 aa, Artificial Sequence
  Description of Artificial Sequence: Synthetic peptide
RIRSKYNNYATYYADSVKD

SEQ ID NO: 3696 - protein, 19 aa, Artificial Sequence
  Description of Artificial Sequence: Synthetic peptide
RIRSKYNNYATYYADSVKD

SEQ ID NO: 3697 - protein, 19 aa, Artificial Sequence
  Description of Artificial Sequence: Synthetic peptide
RIKSKTDGGTTDYAAPVKG

SEQ ID NO: 3698 - protein, 19 aa, Artificial Sequence
  Description of Artificial Sequence: Synthetic peptide
RIKSKTYGGTTDYAAPVKG

SEQ ID NO: 3699 - protein, 16 aa, Artificial Sequence
  Description of Artificial Sequence: Synthetic peptide
YIYYSGSTNYNPSLKS

SEQ ID NO: 3700 - protein, 16 aa, Artificial Sequence
  Description of Artificial Sequence: Synthetic peptide
SIYYSGSTYYNPSLKS

SEQ ID NO: 3701 - protein, 16 aa, Artificial Sequence
  Description of Artificial Sequence: Synthetic peptide
LIYWNDDKRYSPSLKS

SEQ ID NO: 3702 - protein, 16 aa, Artificial Sequence
  Description of Artificial Sequence: Synthetic peptide
LIYWNDDKRYSPSLQS

SEQ ID NO: 3703 - protein, 16 aa, Artificial Sequence
  Description of Artificial Sequence: Synthetic peptide
YIYYSGSTYYNPSLKS

SEQ ID NO: 3704 - protein, 16 aa, Artificial Sequence
  Description of Artificial Sequence: Synthetic peptide
YISYSGITNYNPSLKS

SEQ ID NO: 3705 - protein, 17 aa, Artificial Sequence
  Description of Artificial Sequence: Synthetic peptide
AISGSGGSTYYADSVKG

SEQ ID NO: 3706 - protein, 17 aa, Artificial Sequence
  Description of Artificial Sequence: Synthetic peptide
AISGSGGGTYYADSVKG

SEQ ID NO: 3707 - protein, 17 aa, Artificial Sequence
  Description of Artificial Sequence: Synthetic peptide
AISGSGGSTYYADSVKG

SEQ ID NO: 3708 - protein, 17 aa, Artificial Sequence
  Description of Artificial Sequence: Synthetic peptide
TISISGGSTNYADSVKG

SEQ ID NO: 3709 - protein, 17 aa, Artificial Sequence
  Description of Artificial Sequence: Synthetic peptide
VISYDGSNKYYADSVKG

SEQ ID NO: 3710 - protein, 17 aa, Artificial Sequence
  Description of Artificial Sequence: Synthetic peptide
VISYDGSNKYYADSVKG

SEQ ID NO: 3711 - protein, 17 aa, Artificial Sequence
  Description of Artificial Sequence: Synthetic peptide
YISSSGSTIYYADSVKG

SEQ ID NO: 3712 - protein, 17 aa, Artificial Sequence
  Description of Artificial Sequence: Synthetic peptide
YISKSGSTIYYADSVKG

SEQ ID NO: 3713 - protein, 32 aa, Artificial Sequence; identical to SEQ ID NO: 1369
  Description of Artificial Sequence: Synthetic polypeptide

SEQ ID NO: 3714 - protein, 32 aa, Artificial Sequence; identical to SEQ ID NO: 1369
  Description of Artificial Sequence: Synthetic polypeptide

SEQ ID NO: 3715 - protein, 32 aa, Artificial Sequence; identical to SEQ ID NO: 1346
  Description of Artificial Sequence: Synthetic polypeptide

SEQ ID NO: 3716 - protein, 32 aa, Artificial Sequence; identical to SEQ ID NO: 1346
  Description of Artificial Sequence: Synthetic polypeptide

SEQ ID NO: 3717 - protein, 32 aa, Artificial Sequence; identical to SEQ ID NO: 1346
  Description of Artificial Sequence: Synthetic polypeptide

SEQ ID NO: 3718 - protein, 32 aa, Artificial Sequence; identical to SEQ ID NO: 1367
  Description of Artificial Sequence: Synthetic polypeptide

SEQ ID NO: 3719 - protein, 32 aa, Artificial Sequence; identical to SEQ ID NO: 1367
  Description of Artificial Sequence: Synthetic polypeptide

SEQ ID NO: 3720 - protein, 32 aa, Artificial Sequence; identical to SEQ ID NO: 1372
  Description of Artificial Sequence: Synthetic polypeptide

SEQ ID NO: 3721 - protein, 32 aa, Artificial Sequence; identical to SEQ ID NO: 1373
  Description of Artificial Sequence: Synthetic polypeptide

SEQ ID NO: 3722 - protein, 32 aa, Artificial Sequence; identical to SEQ ID NO: 1346
  Description of Artificial Sequence: Synthetic polypeptide

SEQ ID NO: 3723 - protein, 32 aa, Artificial Sequence; identical to SEQ ID NO: 1346
  Description of Artificial Sequence: Synthetic polypeptide

SEQ ID NO: 3724 - protein, 32 aa, Artificial Sequence; identical to SEQ ID NO: 1369
  Description of Artificial Sequence: Synthetic polypeptide

SEQ ID NO: 3725 - protein, 32 aa, Artificial Sequence; identical to SEQ ID NO: 1369
  Description of Artificial Sequence: Synthetic polypeptide

SEQ ID NO: 3726 - protein, 32 aa, Artificial Sequence; identical to SEQ ID NO: 1385
  Description of Artificial Sequence: Synthetic polypeptide

SEQ ID NO: 3727 - protein, 32 aa, Artificial Sequence; identical to SEQ ID NO: 1386
  Description of Artificial Sequence: Synthetic polypeptide

SEQ ID NO: 3728 - protein, 32 aa, Artificial Sequence; identical to SEQ ID NO: 1386
  Description of Artificial Sequence: Synthetic polypeptide

SEQ ID NO: 3729 - protein, 32 aa, Artificial Sequence; identical to SEQ ID NO: 1386
  Description of Artificial Sequence: Synthetic polypeptide

SEQ ID NO: 3730 - protein, 32 aa, Artificial Sequence; identical to SEQ ID NO: 1386
  Description of Artificial Sequence: Synthetic polypeptide

SEQ ID NO: 3731 - protein, 32 aa, Artificial Sequence; identical to SEQ ID NO: 1386
  Description of Artificial Sequence: Synthetic polypeptide

SEQ ID NO: 3732 - protein, 32 aa, Artificial Sequence; identical to SEQ ID NO: 1386
  Description of Artificial Sequence: Synthetic polypeptide

SEQ ID NO: 3733 - protein, 32 aa, Artificial Sequence; identical to SEQ ID NO: 1386
  Description of Artificial Sequence: Synthetic polypeptide

SEQ ID NO: 3734 - protein, 32 aa, Artificial Sequence; identical to SEQ ID NO: 1386
  Description of Artificial Sequence: Synthetic polypeptide

SEQ ID NO: 3735 - protein, 32 aa, Artificial Sequence; identical to SEQ ID NO: 1386
  Description of Artificial Sequence: Synthetic polypeptide

SEQ ID NO: 3736 - protein, 32 aa, Artificial Sequence; identical to SEQ ID NO: 1374
  Description of Artificial Sequence: Synthetic polypeptide

SEQ ID NO: 3737 - protein, 32 aa, Artificial Sequence; identical to SEQ ID NO: 1379
  Description of Artificial Sequence: Synthetic polypeptide

SEQ ID NO: 3738 - protein, 32 aa, Artificial Sequence; identical to SEQ ID NO: 1374
  Description of Artificial Sequence: Synthetic polypeptide

SEQ ID NO: 3739 - protein, 32 aa, Artificial Sequence; identical to SEQ ID NO: 3361
  Description of Artificial Sequence: Synthetic polypeptide

SEQ ID NO: 3740 - protein, 32 aa, Artificial Sequence; identical to SEQ ID NO: 3362
  Description of Artificial Sequence: Synthetic polypeptide

SEQ ID NO: 3741 - protein, 32 aa, Artificial Sequence; identical to SEQ ID NO: 1441
  Description of Artificial Sequence: Synthetic polypeptide

SEQ ID NO: 3742 - protein, 32 aa, Artificial Sequence; identical to SEQ ID NO: 1442
  Description of Artificial Sequence: Synthetic polypeptide

SEQ ID NO: 3743 - protein, 32 aa, Artificial Sequence; identical to SEQ ID NO: 1442
  Description of Artificial Sequence: Synthetic polypeptide

SEQ ID NO: 3744 - protein, 32 aa, Artificial Sequence; identical to SEQ ID NO: 1442
  Description of Artificial Sequence: Synthetic polypeptide

SEQ ID NO: 3745 - protein, 32 aa, Artificial Sequence; identical to SEQ ID NO: 1442
  Description of Artificial Sequence: Synthetic polypeptide

SEQ ID NO: 3746 - protein, 32 aa, Artificial Sequence; identical to SEQ ID NO: 1442
  Description of Artificial Sequence: Synthetic polypeptide

SEQ ID NO: 3747 - protein, 32 aa, Artificial Sequence; identical to SEQ ID NO: 1442
  Description of Artificial Sequence: Synthetic polypeptide

SEQ ID NO: 3748 - protein, 32 aa, Artificial Sequence; identical to SEQ ID NO: 1442
  Description of Artificial Sequence: Synthetic polypeptide

SEQ ID NO: 3749 - protein, 32 aa, Artificial Sequence; identical to SEQ ID NO: 1442
  Description of Artificial Sequence: Synthetic polypeptide

SEQ ID NO: 3750 - protein, 32 aa, Artificial Sequence; identical to SEQ ID NO: 1442
  Description of Artificial Sequence: Synthetic polypeptide

SEQ ID NO: 3751 - protein, 32 aa, Artificial Sequence; identical to SEQ ID NO: 1480
  Description of Artificial Sequence: Synthetic polypeptide

SEQ ID NO: 3752 - protein, 32 aa, Artificial Sequence; identical to SEQ ID NO: 1480
  Description of Artificial Sequence: Synthetic polypeptide

SEQ ID NO: 3753 - protein, 32 aa, Artificial Sequence; identical to SEQ ID NO: 1499
  Description of Artificial Sequence: Synthetic polypeptide

SEQ ID NO: 3754 - protein, 32 aa, Artificial Sequence; identical to SEQ ID NO: 1499
  Description of Artificial Sequence: Synthetic polypeptide

SEQ ID NO: 3755 - protein, 32 aa, Artificial Sequence; identical to SEQ ID NO: 1490
  Description of Artificial Sequence: Synthetic polypeptide

SEQ ID NO: 3756 - protein, 32 aa, Artificial Sequence; identical to SEQ ID NO: 1479
  Description of Artificial Sequence: Synthetic polypeptide

SEQ ID NO: 3757 - protein, 32 aa, Artificial Sequence; identical to SEQ ID NO: 1499
  Description of Artificial Sequence: Synthetic polypeptide

SEQ ID NO: 3758 - protein, 32 aa, Artificial Sequence; identical to SEQ ID NO: 1507
  Description of Artificial Sequence: Synthetic polypeptide

SEQ ID NO: 3759 - protein, 32 aa, Artificial Sequence; identical to SEQ ID NO: 1427
  Description of Artificial Sequence: Synthetic polypeptide

SEQ ID NO: 3760 - protein, 32 aa, Artificial Sequence; identical to SEQ ID NO: 1428
  Description of Artificial Sequence: Synthetic polypeptide

SEQ ID NO: 3761 - protein, 32 aa, Artificial Sequence; identical to SEQ ID NO: 1427
  Description of Artificial Sequence: Synthetic polypeptide

SEQ ID NO: 3762 - protein, 32 aa, Artificial Sequence; identical to SEQ ID NO: 1427
  Description of Artificial Sequence: Synthetic polypeptide

SEQ ID NO: 3763 - protein, 32 aa, Artificial Sequence; identical to SEQ ID NO: 1501
  Description of Artificial Sequence: Synthetic polypeptide

SEQ ID NO: 3764 - protein, 32 aa, Artificial Sequence; identical to SEQ ID NO: 3386
  Description of Artificial Sequence: Synthetic polypeptide

SEQ ID NO: 3765 - protein, 32 aa, Artificial Sequence; identical to SEQ ID NO: 1504
  Description of Artificial Sequence: Synthetic polypeptide

SEQ ID NO: 3766 - protein, 32 aa, Artificial Sequence; identical to SEQ ID NO: 1505
  Description of Artificial Sequence: Synthetic polypeptide

SEQ ID NO: 3767 - protein, 9 aa, Artificial Sequence
  Description of Artificial Sequence: Synthetic peptide
QKYNSAPYT

SEQ ID NO: 3768 - protein, 9 aa, Artificial Sequence
  Description of Artificial Sequence: Synthetic peptide
QKYNSAPFT

SEQ ID NO: 3769 - protein, 9 aa, Artificial Sequence
  Description of Artificial Sequence: Synthetic peptide
QQSYSTPWT

SEQ ID NO: 3770 - protein, 9 aa, Artificial Sequence
  Description of Artificial Sequence: Synthetic peptide
QQSYSSPFT

SEQ ID NO: 3771 - protein, 9 aa, Artificial Sequence
  Description of Artificial Sequence: Synthetic peptide
QQSYSTPFT

SEQ ID NO: 3772 - protein, 9 aa, Artificial Sequence
  Description of Artificial Sequence: Synthetic peptide
QQYYSTPLT

SEQ ID NO: 3773 - protein, 9 aa, Artificial Sequence
  Description of Artificial Sequence: Synthetic peptide
QQYYSTPLT

SEQ ID NO: 3774 - protein, 9 aa, Artificial Sequence
  Description of Artificial Sequence: Synthetic peptide
MQRIEFPWT

SEQ ID NO: 3775 - protein, 9 aa, Artificial Sequence
  Description of Artificial Sequence: Synthetic peptide
MQALQTPWT

SEQ ID NO: 3776 - protein, 9 aa, Artificial Sequence
  Description of Artificial Sequence: Synthetic peptide
QQSYSTPLT

SEQ ID NO: 3777 - protein, 9 aa, Artificial Sequence
  Description of Artificial Sequence: Synthetic peptide
QQSYSIPLT

SEQ ID NO: 3778 - protein, 9 aa, Artificial Sequence
  Description of Artificial Sequence: Synthetic peptide
QKYNSAPWT

SEQ ID NO: 3779 - protein, 9 aa, Artificial Sequence
  Description of Artificial Sequence: Synthetic peptide
QKYNSAPFT

SEQ ID NO: 3780 - protein, 10 aa, Artificial Sequence
  Description of Artificial Sequence: Synthetic peptide
LLYYGGAQWV

SEQ ID NO: 3781 - protein, 9 aa, Artificial Sequence
  Description of Artificial Sequence: Synthetic peptide
VLWYSNRWV

SEQ ID NO: 3782 - protein, 9 aa, Artificial Sequence
  Description of Artificial Sequence: Synthetic peptide
VLWYSNRWV

SEQ ID NO: 3783 - protein, 9 aa, Artificial Sequence
  Description of Artificial Sequence: Synthetic peptide
VLWYSNRWV

SEQ ID NO: 3784 - protein, 9 aa, Artificial Sequence
  Description of Artificial Sequence: Synthetic peptide
VLWYSNRWV

SEQ ID NO: 3785 - protein, 9 aa, Artificial Sequence
  Description of Artificial Sequence: Synthetic peptide
VLWYSNRWV

SEQ ID NO: 3786 - protein, 9 aa, Artificial Sequence
  Description of Artificial Sequence: Synthetic peptide
VLWYSNRWV

SEQ ID NO: 3787 - protein, 9 aa, Artificial Sequence
  Description of Artificial Sequence: Synthetic peptide
VLWYSNRWV

SEQ ID NO: 3788 - protein, 9 aa, Artificial Sequence
  Description of Artificial Sequence: Synthetic peptide
VLWYSNRWV

SEQ ID NO: 3789 - protein, 9 aa, Artificial Sequence
  Description of Artificial Sequence: Synthetic peptide
VLWYSNRWV

SEQ ID NO: 3790 - protein, 11 aa, Artificial Sequence
  Description of Artificial Sequence: Synthetic peptide
QVWDSSSDHVV

SEQ ID NO: 3791 - protein, 11 aa, Artificial Sequence
  Description of Artificial Sequence: Synthetic peptide
QVWDSSSDHVV

SEQ ID NO: 3792 - protein, 12 aa, Artificial Sequence
  Description of Artificial Sequence: Synthetic peptide
QVWDSSSDHHVV

SEQ ID NO: 3793 - protein, 10 aa, Artificial Sequence
  Description of Artificial Sequence: Synthetic peptide
GIAAAGYFDY

SEQ ID NO: 3794 - protein, 7 aa, Artificial Sequence
  Description of Artificial Sequence: Synthetic peptide
GRATFDY

SEQ ID NO: 3795 - protein, 13 aa, Artificial Sequence
  Description of Artificial Sequence: Synthetic peptide
ITIFGVVIIYFDY

SEQ ID NO: 3796 - protein, 14 aa, Artificial Sequence
  Description of Artificial Sequence: Synthetic peptide
HGNFGNSYISYWAY

SEQ ID NO: 3797 - protein, 14 aa, Artificial Sequence
  Description of Artificial Sequence: Synthetic peptide
HGNFGNSYISYWAY

SEQ ID NO: 3798 - protein, 14 aa, Artificial Sequence
  Description of Artificial Sequence: Synthetic peptide
HGNFGNSYISYWAY

SEQ ID NO: 3799 - protein, 14 aa, Artificial Sequence
  Description of Artificial Sequence: Synthetic peptide
HGNFGNSYISYWAY

SEQ ID NO: 3800 - protein, 14 aa, Artificial Sequence
  Description of Artificial Sequence: Synthetic peptide
HGNFGNSYISYWAY

SEQ ID NO: 3801 - protein, 14 aa, Artificial Sequence
  Description of Artificial Sequence: Synthetic peptide
HGNFGNSYISYWAY

SEQ ID NO: 3802 - protein, 14 aa, Artificial Sequence
  Description of Artificial Sequence: Synthetic peptide
HGNFGNSYISYWAY

SEQ ID NO: 3803 - protein, 14 aa, Artificial Sequence
  Description of Artificial Sequence: Synthetic peptide
HGNFGNSYISYWAY

SEQ ID NO: 3804 - protein, 14 aa, Artificial Sequence
  Description of Artificial Sequence: Synthetic peptide
HGNFGNSYISYWAY

SEQ ID NO: 3805 - protein, 19 aa, Artificial Sequence
  Description of Artificial Sequence: Synthetic peptide
YYYGSGSYYNYYYYYGMDV

SEQ ID NO: 3806 - protein, 16 aa, Artificial Sequence
  Description of Artificial Sequence: Synthetic peptide
PSYSGSYYNYFSVMDV

SEQ ID NO: 3807 - protein, 13 aa, Artificial Sequence
  Description of Artificial Sequence: Synthetic peptide
ITIFGVVIIYFDY

SEQ ID NO: 3808 - protein, 11 aa, Artificial Sequence
  Description of Artificial Sequence: Synthetic peptide
GIFGVITYFDY

SEQ ID NO: 3809 - protein, 8 aa, Artificial Sequence
  Description of Artificial Sequence: Synthetic peptide
LLLNWFDP

SEQ ID NO: 3810 - protein, 13 aa, Artificial Sequence
  Description of Artificial Sequence: Synthetic peptide
RRYNWNYENWFDP

SEQ ID NO: 3811 - protein, 18 aa, Artificial Sequence
  Description of Artificial Sequence: Synthetic peptide
ITMVRGVIIYYYYYGMDV

SEQ ID NO: 3812 - protein, 16 aa, Artificial Sequence
  Description of Artificial Sequence: Synthetic peptide
EKMWFGVLNYYYGMDV

SEQ ID NO: 3813 - protein, 10 aa, Artificial Sequence
  Description of Artificial Sequence: Synthetic peptide
GIAVAGYFDY

SEQ ID NO: 3814 - protein, 10 aa, Artificial Sequence
  Description of Artificial Sequence: Synthetic peptide
GKGVHLGFDY

SEQ ID NO: 3815 - protein, 16 aa, Artificial Sequence
  Description of Artificial Sequence: Synthetic peptide
GYSSGWYYYYYYGMDV

SEQ ID NO: 3816 - protein, 17 aa, Artificial Sequence
  Description of Artificial Sequence: Synthetic peptide
DGGSGWFPKLLHYGLDV

SEQ ID NO: 3817 - protein, 9 aa, Artificial Sequence
  Description of Artificial Sequence: Synthetic peptide
VQLERYFDY

SEQ ID NO: 3818 - protein, 7 aa, Artificial Sequence
  Description of Artificial Sequence: Synthetic peptide
GQLLTGY

SEQ ID NO: 3819 - protein, 9 aa, Artificial Sequence
  Description of Artificial Sequence: Synthetic peptide
YNWNDYFDY

SEQ ID NO: 3820 - protein, 8 aa, Artificial Sequence
  Description of Artificial Sequence: Synthetic peptide
YNYGHFDY

SEQ ID NO: 3821 - protein, 10 aa, Artificial Sequence
  Description of Artificial Sequence: Synthetic peptide
FGQGTKLEIK

SEQ ID NO: 3822 - protein, 10 aa, Artificial Sequence
  Description of Artificial Sequence: Synthetic peptide
FGCGTKLEIK

SEQ ID NO: 3823 - protein, 10 aa, Artificial Sequence
  Description of Artificial Sequence: Synthetic peptide
FGQGTKVEIK

SEQ ID NO: 3824 - protein, 10 aa, Artificial Sequence
  Description of Artificial Sequence: Synthetic peptide
FGCGTKVEIK

SEQ ID NO: 3825 - protein, 10 aa, Artificial Sequence
  Description of Artificial Sequence: Synthetic peptide
FGCGTKVEIK

SEQ ID NO: 3826 - protein, 10 aa, Artificial Sequence
  Description of Artificial Sequence: Synthetic peptide
FGGGTKVEIK

SEQ ID NO: 3827 - protein, 10 aa, Artificial Sequence
  Description of Artificial Sequence: Synthetic peptide
FGCGTKVEIK

SEQ ID NO: 3828 - protein, 10 aa, Artificial Sequence
  Description of Artificial Sequence: Synthetic peptide
FGQGTKVEIK

SEQ ID NO: 3829 - protein, 10 aa, Artificial Sequence
  Description of Artificial Sequence: Synthetic peptide
FGCGTKVEIK

SEQ ID NO: 3830 - protein, 10 aa, Artificial Sequence
  Description of Artificial Sequence: Synthetic peptide
FGGGTKVEIK

SEQ ID NO: 3831 - protein, 10 aa, Artificial Sequence
  Description of Artificial Sequence: Synthetic peptide
FGCGTKVEIK

SEQ ID NO: 3832 - protein, 10 aa, Artificial Sequence
  Description of Artificial Sequence: Synthetic peptide
FGQGTKVEIK

SEQ ID NO: 3833 - protein, 10 aa, Artificial Sequence
  Description of Artificial Sequence: Synthetic peptide
FGCGTKVEIK

SEQ ID NO: 3834 - protein, 10 aa, Artificial Sequence
  Description of Artificial Sequence: Synthetic peptide
FGGGTKLTVL

SEQ ID NO: 3835 - protein, 10 aa, Artificial Sequence
  Description of Artificial Sequence: Synthetic peptide
FGGGTKLTVL

SEQ ID NO: 3836 - protein, 10 aa, Artificial Sequence
  Description of Artificial Sequence: Synthetic peptide
FGGGTKLTVL

SEQ ID NO: 3837 - protein, 10 aa, Artificial Sequence
  Description of Artificial Sequence: Synthetic peptide
FGGGTKLTVL

SEQ ID NO: 3838 - protein, 10 aa, Artificial Sequence
  Description of Artificial Sequence: Synthetic peptide
FGGGTKLTVL

SEQ ID NO: 3839 - protein, 10 aa, Artificial Sequence
  Description of Artificial Sequence: Synthetic peptide
FGGGTKLTVL

SEQ ID NO: 3840 - protein, 10 aa, Artificial Sequence
  Description of Artificial Sequence: Synthetic peptide
FGGGTKLTVL

SEQ ID NO: 3841 - protein, 10 aa, Artificial Sequence
  Description of Artificial Sequence: Synthetic peptide
FGGGTKLTVL

SEQ ID NO: 3842 - protein, 10 aa, Artificial Sequence
  Description of Artificial Sequence: Synthetic peptide
FGGGTKLTVL

SEQ ID NO: 3843 - protein, 10 aa, Artificial Sequence
  Description of Artificial Sequence: Synthetic peptide
FGGGTKLTVL

SEQ ID NO: 3844 - protein, 10 aa, Artificial Sequence
  Description of Artificial Sequence: Synthetic peptide
FGGGTKLTVL

SEQ ID NO: 3845 - protein, 10 aa, Artificial Sequence
  Description of Artificial Sequence: Synthetic peptide
FGCGTKLTVL

SEQ ID NO: 3846 - protein, 10 aa, Artificial Sequence
  Description of Artificial Sequence: Synthetic peptide
FGCGTKLTVS

SEQ ID NO: 3847 - protein, 11 aa, Artificial Sequence
  Description of Artificial Sequence: Synthetic peptide
WGQGTLVTVSS

SEQ ID NO: 3848 - protein, 11 aa, Artificial Sequence
  Description of Artificial Sequence: Synthetic peptide
WGQGTLVTVSS

SEQ ID NO: 3849 - protein, 11 aa, Artificial Sequence
  Description of Artificial Sequence: Synthetic peptide
WGQGTLVTVSS

SEQ ID NO: 3850 - protein, 11 aa, Artificial Sequence
  Description of Artificial Sequence: Synthetic peptide
WGQGTLVTVSS

SEQ ID NO: 3851 - protein, 11 aa, Artificial Sequence
  Description of Artificial Sequence: Synthetic peptide
WGQGTLVTVSS

SEQ ID NO: 3852 - protein, 11 aa, Artificial Sequence
  Description of Artificial Sequence: Synthetic peptide
WGQGTLVTVSS

SEQ ID NO: 3853 - protein, 11 aa, Artificial Sequence
  Description of Artificial Sequence: Synthetic peptide
WGQGTLVTVSS

SEQ ID NO: 3854 - protein, 11 aa, Artificial Sequence
  Description of Artificial Sequence: Synthetic peptide
WGQGTLVTVSS

SEQ ID NO: 3855 - protein, 11 aa, Artificial Sequence
  Description of Artificial Sequence: Synthetic peptide
WGQGTLVTVSS

SEQ ID NO: 3856 - protein, 11 aa, Artificial Sequence
  Description of Artificial Sequence: Synthetic peptide
WGQGTLVTVSS

SEQ ID NO: 3857 - protein, 11 aa, Artificial Sequence
  Description of Artificial Sequence: Synthetic peptide
WGQGTLVTVSS

SEQ ID NO: 3858 - protein, 11 aa, Artificial Sequence
  Description of Artificial Sequence: Synthetic peptide
WGQGTLVTVSS

SEQ ID NO: 3859 - protein, 11 aa, Artificial Sequence
  Description of Artificial Sequence: Synthetic peptide
WGQGTTVTVSS

SEQ ID NO: 3860 - protein, 11 aa, Artificial Sequence
  Description of Artificial Sequence: Synthetic peptide
WGQGTTVTVSS

SEQ ID NO: 3861 - protein, 11 aa, Artificial Sequence
  Description of Artificial Sequence: Synthetic peptide
WGQGTLVTVSS

SEQ ID NO: 3862 - protein, 11 aa, Artificial Sequence
  Description of Artificial Sequence: Synthetic peptide
WGQGTLVTVSS

SEQ ID NO: 3863 - protein, 11 aa, Artificial Sequence
  Description of Artificial Sequence: Synthetic peptide
WGQGTLVTVSS

SEQ ID NO: 3864 - protein, 11 aa, Artificial Sequence
  Description of Artificial Sequence: Synthetic peptide
WGQGTLVTVSS

SEQ ID NO: 3865 - protein, 11 aa, Artificial Sequence
  Description of Artificial Sequence: Synthetic peptide
WGQGTTVTVSS

SEQ ID NO: 3866 - protein, 11 aa, Artificial Sequence
  Description of Artificial Sequence: Synthetic peptide
WGQGTTVTVSS

SEQ ID NO: 3867 - protein, 11 aa, Artificial Sequence
  Description of Artificial Sequence: Synthetic peptide
WGQGTLVTVSS

SEQ ID NO: 3868 - protein, 11 aa, Artificial Sequence
  Description of Artificial Sequence: Synthetic peptide
WGQGTLVTVSS

SEQ ID NO: 3869 - protein, 11 aa, Artificial Sequence
  Description of Artificial Sequence: Synthetic peptide
WGQGTTVTVSS

SEQ ID NO: 3870 - protein, 11 aa, Artificial Sequence
  Description of Artificial Sequence: Synthetic peptide
WGQGTTVTVSS

SEQ ID NO: 3871 - protein, 11 aa, Artificial Sequence
  Description of Artificial Sequence: Synthetic peptide
WGQGTLVTVSS

SEQ ID NO: 3872 - protein, 11 aa, Artificial Sequence
  Description of Artificial Sequence: Synthetic peptide
WGQGTLVTVSS

SEQ ID NO: 3873 - protein, 11 aa, Artificial Sequence
  Description of Artificial Sequence: Synthetic peptide
WGQGTLVTVSS

SEQ ID NO: 3874 - protein, 11 aa, Artificial Sequence
  Description of Artificial Sequence: Synthetic peptide
WGQGTLVTVSS

SEQ ID NO: 3875 - protein, 1008 aa, Artificial Sequence
  Description of Artificial Sequence: Synthetic polypeptide
MDMRVPAQLLGLLLLWLRGARCEVQLVESGGGLVKPGGSLRLSCAASGFTFSTYSMNWVRQAPGKCLEWVSSISSSSSYIYYADSVKGRFTISRDNAKNSLYLQMNSLRDEDTAVYYCARDRIAVATYFDNWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYANSPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3876 - protein, 1019 aa, Artificial Sequence
  Description of Artificial Sequence: Synthetic polypeptide
MDMRVPAQLLGLLLLWLRGARCQVQLVESGGGVVQPGRSLRLSCAASGFTFSSYGMHWVRQAPGKCLEWVALISYDGSSKYYADSVKGRFTISRDNSKNTLDLQMNSLRAEDTAVYYCARSPYDYVWGSYRNYYYGMDVWGQGTTVTVSSGGGGSGGGGSGGGGSQAVVTQEPSLTVSPGGTVTLTCGSSTGAVTSGHYPYWFQQKPGQAPRTLIYDTSNKHSWTPARFSGSLLGGKAALTLSGAQPEDEAEYYCFLSYSGARNWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3877 - protein, 1013 aa, Artificial Sequence
  Description of Artificial Sequence: Synthetic polypeptide
MDMRVPAQLLGLLLLWLRGARCEVQLLEQSGPELVKPGASVKISCKASGYAFSKSWMNWVKQRPGKCLEWIGRIYPGDGDTNYNGKFKGKAALTADKSSNTANMQLNSLTSEDSAVYFCARDGVFYAPLAYWGQGTLVTVSSGGGGSGGGGSGGGGSELVMTQSPSSLAVSVGEKITMSCKSSQSLLYSSNQKNYLAWYQQKPGQSPKLLIYWASTRESGVPDRFTGSGSGTDFTLTISSVKAEDLAVYYCQQYYSYPYTFGCGTKLELKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3878 - protein, 1009 aa, Artificial Sequence
  Description of Artificial Sequence: Synthetic polypeptide
MDMRVPAQLLGLLLLWLRGARCEVQLLEQSGPELVKPGASVKISCKASDYTFSKSWMNWVKQRPGECLEWIGRVWPGDGDTTYNEKFKGKATLTADKSSRTAYMQLSSLTSEDSAVYFCARGNYFGSSEAYFDYWGQGTRVTVSSGGGGSGGGGSGGGGSELVLTQSPAIMSASPGQKVTITCSASSNVNYIHWYQQKLGSSPKLWIYDTSKLAPGVPARFSGSGSGTSYSLTISSMEAEDAASYFCHQWSSYPPTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3879 - protein, 1008 aa, Artificial Sequence
  Description of Artificial Sequence: Synthetic polypeptide
MDMRVPAQLLGLLLLWLRGARCEVQLLEQSGPELVKPGASVKISCKASGYAFSSSWMNWVKQRPGKCLEWIGRIYPGDGDTNYNGKFKDKATLTADKSSNTAYMQLSSLTSEDSAVYFCARRQLNHVFAMDYWGQGTSVTVSSGGGGSGGGGSGGGGSELQMTQSPASLSASVGETVTITCRASGNIHNYLAWYQQKQGKSPQLLVYNAKTLAGGVPSRFSGSGSGTQFSLKINSLQPEDFGSYYCQHHYGTPLTFGCGTKLELKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3880 - protein, 1015 aa, Artificial Sequence
  Description of Artificial Sequence: Synthetic polypeptide
MDMRVPAQLLGLLLLWLRGARCQVQLVQSGAEVKKPGASVKVSCKASGYTFTSYDINWVRQATGQCLEWMGWMNPNSGNTGYAQKFQGRVTMTRNTSISTAYMELSSLRSEDTAVYYCARGGGYSNGYDYGMDVWGQGTTVTVSSGGGGSGGGGSGGGGSDIVMTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPPTFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3881 - protein, 1014 aa, Artificial Sequence
  Description of Artificial Sequence: Synthetic polypeptide
MDMRVPAQLLGLLLLWLRGARCQVQLQQWGAGMLKPSETLSLTCAVYGGSFSGYYWNWIRQPPGKCLEWIGEINHSGSTNYNPSLKSRVTISVDTSKNQFSLKLSSVTAADTAVYYCARGGGYSYGYDYGMDVWGQGTTVTVSSGGGGSGGGGSGGGGSDIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3882 - protein, 1009 aa, Artificial Sequence
  Description of Artificial Sequence: Synthetic polypeptide
MDMRVPAQLLGLLLLWLRGARCQVQLVESGGGVVQPGRSLRLSCAASGFTFRSYRMHWVRQAPGKCLEWVAVISYDGGNKYYADSVKGRFTISRDNSKNTLYLQMNSLRAEDTAVYYCAREQWPNYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3883 - protein, 12 aa, Artificial Sequence
  Description of Artificial Sequence: Synthetic peptide
RASQSVSSSYLA

SEQ ID NO: 3884 - protein, 14 aa, Artificial Sequence
  Description of Artificial Sequence: Synthetic peptide
GSSTGAVTSGHYPY

SEQ ID NO: 3885 - protein, 17 aa, Artificial Sequence
  Description of Artificial Sequence: Synthetic peptide
KSSQSLLYSSNQKNYLA

SEQ ID NO: 3886 - protein, 10 aa, Artificial Sequence
  Description of Artificial Sequence: Synthetic peptide
SASSNVNYIH

SEQ ID NO: 3887 - protein, 11 aa, Artificial Sequence
  Description of Artificial Sequence: Synthetic peptide
RASGNIHNYLA

SEQ ID NO: 3888 - protein, 16 aa, Artificial Sequence
  Description of Artificial Sequence: Synthetic peptide
RSSQSLLYSNGYNYVD

SEQ ID NO: 3889 - protein, 16 aa, Artificial Sequence
  Description of Artificial Sequence: Synthetic peptide
RSSQSLLYSNGYNYLD

SEQ ID NO: 3890 - protein, 12 aa, Artificial Sequence
  Description of Artificial Sequence: Synthetic peptide
RASQSVSSSYLA

SEQ ID NO: 3891 - protein, 5 aa, Artificial Sequence
  Description of Artificial Sequence: Synthetic peptide
TYSMN

SEQ ID NO: 3892 - protein, 5 aa, Artificial Sequence
  Description of Artificial Sequence: Synthetic peptide
SYGMH

SEQ ID NO: 3893 - protein, 5 aa, Artificial Sequence
  Description of Artificial Sequence: Synthetic peptide
KSWMN

SEQ ID NO: 3894 - protein, 5 aa, Artificial Sequence
  Description of Artificial Sequence: Synthetic peptide
KSWMN

SEQ ID NO: 3895 - protein, 5 aa, Artificial Sequence
  Description of Artificial Sequence: Synthetic peptide
SSWMN

SEQ ID NO: 3896 - protein, 5 aa, Artificial Sequence
  Description of Artificial Sequence: Synthetic peptide
SYDIN

SEQ ID NO: 3897 - protein, 5 aa, Artificial Sequence
  Description of Artificial Sequence: Synthetic peptide
GYYWN

SEQ ID NO: 3898 - protein, 5 aa, Artificial Sequence
  Description of Artificial Sequence: Synthetic peptide
SYRMH

SEQ ID NO: 3899 - protein, 14 aa, Artificial Sequence
  Description of Artificial Sequence: Synthetic peptide
GSSTGAVTSGNYPN

SEQ ID NO: 3900 - protein, 14 aa, Artificial Sequence
  Description of Artificial Sequence: Synthetic peptide
GSSTGAVTSGNYPN

SEQ ID NO: 3901 - protein, 14 aa, Artificial Sequence
  Description of Artificial Sequence: Synthetic peptide
GSSTGAVTSGNYPN

SEQ ID NO: 3902 - protein, 14 aa, Artificial Sequence
  Description of Artificial Sequence: Synthetic peptide
GSSTGAVTSGNYPN

SEQ ID NO: 3903 - protein, 14 aa, Artificial Sequence
  Description of Artificial Sequence: Synthetic peptide
GSSTGAVTSGNYPN

SEQ ID NO: 3904 - protein, 14 aa, Artificial Sequence
  Description of Artificial Sequence: Synthetic peptide
GSSTGAVTSGNYPN

SEQ ID NO: 3905 - protein, 14 aa, Artificial Sequence
  Description of Artificial Sequence: Synthetic peptide
GSSTGAVTSGNYPN

SEQ ID NO: 3906 - protein, 14 aa, Artificial Sequence
  Description of Artificial Sequence: Synthetic peptide
GSSTGAVTSGNYPN

SEQ ID NO: 3907 - protein, 5 aa, Artificial Sequence
  Description of Artificial Sequence: Synthetic peptide
KYAMN

SEQ ID NO: 3908 - protein, 5 aa, Artificial Sequence
  Description of Artificial Sequence: Synthetic peptide
KYAMN

SEQ ID NO: 3909 - protein, 5 aa, Artificial Sequence
  Description of Artificial Sequence: Synthetic peptide
KYAMN

SEQ ID NO: 3910 - protein, 5 aa, Artificial Sequence
  Description of Artificial Sequence: Synthetic peptide
KYAMN

SEQ ID NO: 3911 - protein, 5 aa, Artificial Sequence
  Description of Artificial Sequence: Synthetic peptide
KYAMN

SEQ ID NO: 3912 - protein, 5 aa, Artificial Sequence
  Description of Artificial Sequence: Synthetic peptide
KYAMN

SEQ ID NO: 3913 - protein, 5 aa, Artificial Sequence
  Description of Artificial Sequence: Synthetic peptide
KYAMN

SEQ ID NO: 3914 - protein, 5 aa, Artificial Sequence
  Description of Artificial Sequence: Synthetic peptide
KYAMN

SEQ ID NO: 3915 - protein, 7 aa, Artificial Sequence
  Description of Artificial Sequence: Synthetic peptide
GASSRAT

SEQ ID NO: 3916 - protein, 7 aa, Artificial Sequence
  Description of Artificial Sequence: Synthetic peptide
DTSNKHS

SEQ ID NO: 3917 - protein, 7 aa, Artificial Sequence
  Description of Artificial Sequence: Synthetic peptide
WASTRES

SEQ ID NO: 3918 - protein, 7 aa, Artificial Sequence
  Description of Artificial Sequence: Synthetic peptide
DTSKLAP

SEQ ID NO: 3919 - protein, 7 aa, Artificial Sequence
  Description of Artificial Sequence: Synthetic peptide
NAKTLAG

SEQ ID NO: 3920 - protein, 7 aa, Artificial Sequence
  Description of Artificial Sequence: Synthetic peptide
LGSNRAS

SEQ ID NO: 3921 - protein, 7 aa, Artificial Sequence
  Description of Artificial Sequence: Synthetic peptide
LGSNRAS

SEQ ID NO: 3922 - protein, 7 aa, Artificial Sequence
  Description of Artificial Sequence: Synthetic peptide
GASSRAT

SEQ ID NO: 3923 - protein, 17 aa, Artificial Sequence
  Description of Artificial Sequence: Synthetic peptide
SISSSSSYIYYADSVKG

SEQ ID NO: 3924 - protein, 17 aa, Artificial Sequence
  Description of Artificial Sequence: Synthetic peptide
LISYDGSSKYYADSVKG

SEQ ID NO: 3925 - protein, 17 aa, Artificial Sequence
  Description of Artificial Sequence: Synthetic peptide
RIYPGDGDTNYNGKFKG

SEQ ID NO: 3926 - protein, 17 aa, Artificial Sequence
  Description of Artificial Sequence: Synthetic peptide
RVWPGDGDTTYNEKFKG

SEQ ID NO: 3927 - protein, 17 aa, Artificial Sequence
  Description of Artificial Sequence: Synthetic peptide
RIYPGDGDTNYNGKFKD

SEQ ID NO: 3928 - protein, 17 aa, Artificial Sequence
  Description of Artificial Sequence: Synthetic peptide
WMNPNSGNTGYAQKFQG

SEQ ID NO: 3929 - protein, 16 aa, Artificial Sequence
  Description of Artificial Sequence: Synthetic peptide
EINHSGSTNYNPSLKS

SEQ ID NO: 3930 - protein, 17 aa, Artificial Sequence
  Description of Artificial Sequence: Synthetic peptide
VISYDGGNKYYADSVKG

SEQ ID NO: 3931 - protein, 7 aa, Artificial Sequence
  Description of Artificial Sequence: Synthetic peptide
GTKFLAP

SEQ ID NO: 3932 - protein, 7 aa, Artificial Sequence
  Description of Artificial Sequence: Synthetic peptide
GTKFLAP

SEQ ID NO: 3933 - protein, 7 aa, Artificial Sequence
  Description of Artificial Sequence: Synthetic peptide
GTKFLAP

SEQ ID NO: 3934 - protein, 7 aa, Artificial Sequence
  Description of Artificial Sequence: Synthetic peptide
GTKFLAP

SEQ ID NO: 3935 - protein, 7 aa, Artificial Sequence
  Description of Artificial Sequence: Synthetic peptide
GTKFLAP

SEQ ID NO: 3936 - protein, 7 aa, Artificial Sequence
  Description of Artificial Sequence: Synthetic peptide
GTKFLAP

SEQ ID NO: 3937 - protein, 7 aa, Artificial Sequence
  Description of Artificial Sequence: Synthetic peptide
GTKFLAP

SEQ ID NO: 3938 - protein, 7 aa, Artificial Sequence
  Description of Artificial Sequence: Synthetic peptide
GTKFLAP

SEQ ID NO: 3939 - protein, 19 aa, Artificial Sequence
  Description of Artificial Sequence: Synthetic peptide
RIRSKYNNYATYYADSVKD

SEQ ID NO: 3940 - protein, 19 aa, Artificial Sequence
  Description of Artificial Sequence: Synthetic peptide
RIRSKYNNYATYYADSVKD

SEQ ID NO: 3941 - protein, 19 aa, Artificial Sequence
  Description of Artificial Sequence: Synthetic peptide
RIRSKYNNYATYYADSVKD

SEQ ID NO: 3942 - protein, 19 aa, Artificial Sequence
  Description of Artificial Sequence: Synthetic peptide
RIRSKYNNYATYYADSVKD

SEQ ID NO: 3943 - protein, 19 aa, Artificial Sequence
  Description of Artificial Sequence: Synthetic peptide
RIRSKYNNYATYYADSVKD

SEQ ID NO: 3944 - protein, 19 aa, Artificial Sequence
  Description of Artificial Sequence: Synthetic peptide
RIRSKYNNYATYYADSVKD

SEQ ID NO: 3945 - protein, 19 aa, Artificial Sequence
  Description of Artificial Sequence: Synthetic peptide
RIRSKYNNYATYYADSVKD

SEQ ID NO: 3946 - protein, 19 aa, Artificial Sequence
  Description of Artificial Sequence: Synthetic peptide
RIRSKYNNYATYYADSVKD

SEQ ID NO: 3947 - protein, 9 aa, Artificial Sequence
  Description of Artificial Sequence: Synthetic peptide
QQYANSPLT

SEQ ID NO: 3948 - protein, 11 aa, Artificial Sequence
  Description of Artificial Sequence: Synthetic peptide
FLSYSGARNWV

SEQ ID NO: 3949 - protein, 9 aa, Artificial Sequence
  Description of Artificial Sequence: Synthetic peptide
QQYYSYPYT

SEQ ID NO: 3950 - protein, 9 aa, Artificial Sequence
  Description of Artificial Sequence: Synthetic peptide
HQWSSYPPT

SEQ ID NO: 3951 - protein, 9 aa, Artificial Sequence
  Description of Artificial Sequence: Synthetic peptide
QHHYGTPLT

SEQ ID NO: 3952 - protein, 9 aa, Artificial Sequence
  Description of Artificial Sequence: Synthetic peptide
MQALQTPPT

SEQ ID NO: 3953 - protein, 9 aa, Artificial Sequence
  Description of Artificial Sequence: Synthetic peptide
MQALQTPPT

SEQ ID NO: 3954 - protein, 9 aa, Artificial Sequence
  Description of Artificial Sequence: Synthetic peptide
QQYGSSPLT

SEQ ID NO: 3955 - protein, 11 aa, Artificial Sequence
  Description of Artificial Sequence: Synthetic peptide
DRIAVATYFDN

SEQ ID NO: 3956 - protein, 18 aa, Artificial Sequence
  Description of Artificial Sequence: Synthetic peptide
PYDYVWGSYRNYYYGMDV

SEQ ID NO: 3957 - protein, 10 aa, Artificial Sequence
  Description of Artificial Sequence: Synthetic peptide
DGVFYAPLAY

SEQ ID NO: 3958 - protein, 13 aa, Artificial Sequence
  Description of Artificial Sequence: Synthetic peptide
GNYFGSSEAYFDY

SEQ ID NO: 3959 - protein, 11 aa, Artificial Sequence
  Description of Artificial Sequence: Synthetic peptide
RQLNHVFAMDY

SEQ ID NO: 3960 - protein, 14 aa, Artificial Sequence
  Description of Artificial Sequence: Synthetic peptide
GGGYSNGYDYGMDV

SEQ ID NO: 3961 - protein, 14 aa, Artificial Sequence
  Description of Artificial Sequence: Synthetic peptide
GGGYSYGYDYGMDV

SEQ ID NO: 3962 - protein, 12 aa, Artificial Sequence
  Description of Artificial Sequence: Synthetic peptide
EQWPNYYYGMDV

SEQ ID NO: 3963 - protein, 9 aa, Artificial Sequence
  Description of Artificial Sequence: Synthetic peptide
VLWYSNRWV

SEQ ID NO: 3964 - protein, 9 aa, Artificial Sequence
  Description of Artificial Sequence: Synthetic peptide
VLWYSNRWV

SEQ ID NO: 3965 - protein, 9 aa, Artificial Sequence
  Description of Artificial Sequence: Synthetic peptide
VLWYSNRWV

SEQ ID NO: 3966 - protein, 9 aa, Artificial Sequence
  Description of Artificial Sequence: Synthetic peptide
VLWYSNRWV

SEQ ID NO: 3967 - protein, 9 aa, Artificial Sequence
  Description of Artificial Sequence: Synthetic peptide
VLWYSNRWV

SEQ ID NO: 3968 - protein, 9 aa, Artificial Sequence
  Description of Artificial Sequence: Synthetic peptide
VLWYSNRWV

SEQ ID NO: 3969 - protein, 9 aa, Artificial Sequence
  Description of Artificial Sequence: Synthetic peptide
VLWYSNRWV

SEQ ID NO: 3970 - protein, 9 aa, Artificial Sequence
  Description of Artificial Sequence: Synthetic peptide
VLWYSNRWV

SEQ ID NO: 3971 - protein, 14 aa, Artificial Sequence
  Description of Artificial Sequence: Synthetic peptide
HGNFGNSYISYWAY

SEQ ID NO: 3972 - protein, 14 aa, Artificial Sequence
  Description of Artificial Sequence: Synthetic peptide
HGNFGNSYISYWAY

SEQ ID NO: 3973 - protein, 14 aa, Artificial Sequence
  Description of Artificial Sequence: Synthetic peptide
HGNFGNSYISYWAY

SEQ ID NO: 3974 - protein, 14 aa, Artificial Sequence
  Description of Artificial Sequence: Synthetic peptide
HGNFGNSYISYWAY

SEQ ID NO: 3975 - protein, 14 aa, Artificial Sequence
  Description of Artificial Sequence: Synthetic peptide
HGNFGNSYISYWAY

SEQ ID NO: 3976 - protein, 14 aa, Artificial Sequence
  Description of Artificial Sequence: Synthetic peptide
HGNFGNSYISYWAY

SEQ ID NO: 3977 - protein, 14 aa, Artificial Sequence
  Description of Artificial Sequence: Synthetic peptide
HGNFGNSYISYWAY

SEQ ID NO: 3978 - protein, 14 aa, Artificial Sequence
  Description of Artificial Sequence: Synthetic peptide
HGNFGNSYISYWAY

SEQ ID NO: 3979 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYANSPLTFGCGTKVEIK

SEQ ID NO: 3980 - protein, 111 aa, Artificial Sequence
  Description of Artificial Sequence: Synthetic polypeptide
QAVVTQEPSLTVSPGGTVTLTCGSSTGAVTSGHYPYWFQQKPGQAPRTLIYDTSNKHSWTPARFSGSLLGGKAALTLSGAQPEDEAEYYCFLSYSGARNWVFGCGTKLTVL

SEQ ID NO: 3981 - protein, 113 aa, Artificial Sequence
  Description of Artificial Sequence: Synthetic polypeptide
ELVMTQSPSSLAVSVGEKITMSCKSSQSLLYSSNQKNYLAWYQQKPGQSPKLLIYWASTRESGVPDRFTGSGSGTDFTLTISSVKAEDLAVYYCQQYYSYPYTFGCGTKLELK

SEQ ID NO: 3982 - protein, 106 aa, Artificial Sequence
  Description of Artificial Sequence: Synthetic polypeptide
ELVLTQSPAIMSASPGQKVTITCSASSNVNYIHWYQQKLGSSPKLWIYDTSKLAPGVPARFSGSGSGTSYSLTISSMEAEDAASYFCHQWSSYPPTFGCGTKLEIK

SEQ ID NO: 3983 - protein, 107 aa, Artificial Sequence
  Description of Artificial Sequence: Synthetic polypeptide
ELQMTQSPASLSASVGETVTITCRASGNIHNYLAWYQQKQGKSPQLLVYNAKTLAGGVPSRFSGSGSGTQFSLKINSLQPEDFGSYYCQHHYGTPLTFGCGTKLELK

SEQ ID NO: 3984 - protein, 112 aa, Artificial Sequence
  Description of Artificial Sequence: Synthetic polypeptide
DIVMTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPPTFGCGTRLEIK

SEQ ID NO: 3985 - protein, 112 aa, Artificial Sequence
  Description of Artificial Sequence: Synthetic polypeptide
DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPPTFGCGTKVDIK

SEQ ID NO: 3986 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGCGTKLEIK

SEQ ID NO: 3987 - protein, 120 aa, Artificial Sequence
  Description of Artificial Sequence: Synthetic polypeptide
EVQLVESGGGLVKPGGSLRLSCAASGFTFSTYSMNWVRQAPGKCLEWVSSISSSSSYIYYADSVKGRFTISRDNAKNSLYLQMNSLRDEDTAVYYCARDRIAVATYFDNWGQGTLVTVSS

SEQ ID NO: 3988 - protein, 128 aa, Artificial Sequence
  Description of Artificial Sequence: Synthetic polypeptide
QVQLVESGGGVVQPGRSLRLSCAASGFTFSSYGMHWVRQAPGKCLEWVALISYDGSSKYYADSVKGRFTISRDNSKNTLDLQMNSLRAEDTAVYYCARSPYDYVWGSYRNYYYGMDVWGQGTTVTVSS

SEQ ID NO: 3989 - protein, 119 aa, Artificial Sequence
  Description of Artificial Sequence: Synthetic polypeptide
VQLLEQSGPELVKPGASVKISCKASGYAFSKSWMNWVKQRPGKCLEWIGRIYPGDGDTNYNGKFKGKAALTADKSSNTANMQLNSLTSEDSAVYFCARDGVFYAPLAYWGQGTLVTVSS

SEQ ID NO: 3990 - protein, 122 aa, Artificial Sequence
  Description of Artificial Sequence: Synthetic polypeptide
VQLLEQSGPELVKPGASVKISCKASDYTFSKSWMNWVKQRPGECLEWIGRVWPGDGDTTYNEKFKGKATLTADKSSRTAYMQLSSLTSEDSAVYFCARGNYFGSSEAYFDYWGQGTRVTVSS

SEQ ID NO: 3991 - protein, 120 aa, Artificial Sequence
  Description of Artificial Sequence: Synthetic polypeptide
VQLLEQSGPELVKPGASVKISCKASGYAFSSSWMNWVKQRPGKCLEWIGRIYPGDGDTNYNGKFKDKATLTADKSSNTAYMQLSSLTSEDSAVYFCARRQLNHVFAMDYWGQGTSVTVSS

SEQ ID NO: 3992 - protein, 123 aa, Artificial Sequence
  Description of Artificial Sequence: Synthetic polypeptide
QVQLVQSGAEVKKPGASVKVSCKASGYTFTSYDINWVRQATGQCLEWMGWMNPNSGNTGYAQKFQGRVTMTRNTSISTAYMELSSLRSEDTAVYYCARGGGYSNGYDYGMDVWGQGTTVTVSS

SEQ ID NO: 3993 - protein, 122 aa, Artificial Sequence
  Description of Artificial Sequence: Synthetic polypeptide
QVQLQQWGAGMLKPSETLSLTCAVYGGSFSGYYWNWIRQPPGKCLEWIGEINHSGSTNYNPSLKSRVTISVDTSKNQFSLKLSSVTAADTAVYYCARGGGYSYGYDYGMDVWGQGTTVTVSS

SEQ ID NO: 3994 - protein, 121 aa, Artificial Sequence
  Description of Artificial Sequence: Synthetic polypeptide
QVQLVESGGGVVQPGRSLRLSCAASGFTFRSYRMHWVRQAPGKCLEWVAVISYDGGNKYYADSVKGRFTISRDNSKNTLYLQMNSLRAEDTAVYYCAREQWPNYYYGMDVWGQGTTVTVSS

SEQ ID NO: 3995 - protein, 109 aa, Artificial Sequence; identical to SEQ ID NO: 31
  Description of Artificial Sequence: Synthetic polypeptide

SEQ ID NO: 3996 - protein, 109 aa, Artificial Sequence; identical to SEQ ID NO: 31
  Description of Artificial Sequence: Synthetic polypeptide

SEQ ID NO: 3997 - protein, 109 aa, Artificial Sequence; identical to SEQ ID NO: 31
  Description of Artificial Sequence: Synthetic polypeptide

SEQ ID NO: 3998 - protein, 109 aa, Artificial Sequence; identical to SEQ ID NO: 31
  Description of Artificial Sequence: Synthetic polypeptide

SEQ ID NO: 3999 - protein, 109 aa, Artificial Sequence; identical to SEQ ID NO: 31
  Description of Artificial Sequence: Synthetic polypeptide

SEQ ID NO: 4000 - protein, 109 aa, Artificial Sequence; identical to SEQ ID NO: 31
  Description of Artificial Sequence: Synthetic polypeptide

SEQ ID NO: 4001 - protein, 109 aa, Artificial Sequence; identical to SEQ ID NO: 31
  Description of Artificial Sequence: Synthetic polypeptide

SEQ ID NO: 4002 - protein, 109 aa, Artificial Sequence; identical to SEQ ID NO: 31
  Description of Artificial Sequence: Synthetic polypeptide

SEQ ID NO: 4003 - protein, 125 aa, Artificial Sequence; identical to SEQ ID NO: 697
  Description of Artificial Sequence: Synthetic polypeptide

SEQ ID NO: 4004 - protein, 125 aa, Artificial Sequence; identical to SEQ ID NO: 697
  Description of Artificial Sequence: Synthetic polypeptide

SEQ ID NO: 4005 - protein, 125 aa, Artificial Sequence; identical to SEQ ID NO: 697
  Description of Artificial Sequence: Synthetic polypeptide

SEQ ID NO: 4006 - protein, 125 aa, Artificial Sequence; identical to SEQ ID NO: 697
  Description of Artificial Sequence: Synthetic polypeptide

SEQ ID NO: 4007 - protein, 125 aa, Artificial Sequence; identical to SEQ ID NO: 697
  Description of Artificial Sequence: Synthetic polypeptide

SEQ ID NO: 4008 - protein, 125 aa, Artificial Sequence; identical to SEQ ID NO: 697
  Description of Artificial Sequence: Synthetic polypeptide

SEQ ID NO: 4009 - protein, 125 aa, Artificial Sequence; identical to SEQ ID NO: 697
  Description of Artificial Sequence: Synthetic polypeptide

SEQ ID NO: 4010 - protein, 125 aa, Artificial Sequence; identical to SEQ ID NO: 697
  Description of Artificial Sequence: Synthetic polypeptide

SEQ ID NO: 4011 - protein, 23 aa, Artificial Sequence
  Description of Artificial Sequence: Synthetic peptide
EIVLTQSPGTLSLSPGERATLSC

SEQ ID NO: 4012 - protein, 23 aa, Artificial Sequence
  Description of Artificial Sequence: Synthetic peptide
EIVLTQSPGTLSLSPGERATLSC

SEQ ID NO: 4013 - protein, 23 aa, Artificial Sequence
  Description of Artificial Sequence: Synthetic peptide
DIVMTQSPDSLAVSLGERATINC

SEQ ID NO: 4014 - protein, 23 aa, Artificial Sequence
  Description of Artificial Sequence: Synthetic peptide
ELVMTQSPSSLAVSVGEKITMSC

SEQ ID NO: 4015 - protein, 23 aa, Artificial Sequence
  Description of Artificial Sequence: Synthetic peptide
EIVLTQSPDFQSVTPKEKVTITC

SEQ ID NO: 4016 - protein, 23 aa, Artificial Sequence
  Description of Artificial Sequence: Synthetic peptide
ELVLTQSPAIMSASPGQKVTITC

SEQ ID NO: 4017 - protein, 23 aa, Artificial Sequence
  Description of Artificial Sequence: Synthetic peptide
AIQMTQSPSSLSASVGDRVTITC

SEQ ID NO: 4018 - protein, 23 aa, Artificial Sequence
  Description of Artificial Sequence: Synthetic peptide
ELQMTQSPASLSASVGETVTITC

SEQ ID NO: 4019 - protein, 23 aa, Artificial Sequence
  Description of Artificial Sequence: Synthetic peptide
DIVMTQSPLSLPVTPGEPASISC

SEQ ID NO: 4020 - protein, 23 aa, Artificial Sequence
  Description of Artificial Sequence: Synthetic peptide
DIVMTQSPLSLPVSPGEPASISC

SEQ ID NO: 4021 - protein, 23 aa, Artificial Sequence
  Description of Artificial Sequence: Synthetic peptide
DIVMTQSPLSLPVTPGEPASISC

SEQ ID NO: 4022 - protein, 23 aa, Artificial Sequence
  Description of Artificial Sequence: Synthetic peptide
DIVMTQSPLSLPVTPGEPASISC

SEQ ID NO: 4023 - protein, 23 aa, Artificial Sequence
  Description of Artificial Sequence: Synthetic peptide
EIVLTQSPGTLSLSPGERATLSC

SEQ ID NO: 4024 - protein, 23 aa, Artificial Sequence
  Description of Artificial Sequence: Synthetic peptide
EIVLTQSPGTLSLSPGERATLSC

SEQ ID NO: 4025 - protein, 22 aa, Artificial Sequence
  Description of Artificial Sequence: Synthetic peptide
QTVVTQEPSLTVSPGGTVTLTC

SEQ ID NO: 4026 - protein, 22 aa, Artificial Sequence
  Description of Artificial Sequence: Synthetic peptide
QTVVTQEPSLTVSPGGTVTLTC

SEQ ID NO: 4027 - protein, 22 aa, Artificial Sequence
  Description of Artificial Sequence: Synthetic peptide
QTVVTQEPSLTVSPGGTVTLTC

SEQ ID NO: 4028 - protein, 22 aa, Artificial Sequence
  Description of Artificial Sequence: Synthetic peptide
QTVVTQEPSLTVSPGGTVTLTC

SEQ ID NO: 4029 - protein, 22 aa, Artificial Sequence
  Description of Artificial Sequence: Synthetic peptide
QTVVTQEPSLTVSPGGTVTLTC

SEQ ID NO: 4030 - protein, 22 aa, Artificial Sequence
  Description of Artificial Sequence: Synthetic peptide
QTVVTQEPSLTVSPGGTVTLTC

SEQ ID NO: 4031 - protein, 22 aa, Artificial Sequence
  Description of Artificial Sequence: Synthetic peptide
QTVVTQEPSLTVSPGGTVTLTC

SEQ ID NO: 4032 - protein, 22 aa, Artificial Sequence
  Description of Artificial Sequence: Synthetic peptide
QTVVTQEPSLTVSPGGTVTLTC

SEQ ID NO: 4033 - protein, 22 aa, Artificial Sequence
  Description of Artificial Sequence: Synthetic peptide
QTVVTQEPSLTVSPGGTVTLTC

SEQ ID NO: 4034 - protein, 22 aa, Artificial Sequence
  Description of Artificial Sequence: Synthetic peptide
QAVVTQEPSLTVSPGGTVTLTC

SEQ ID NO: 4035 - protein, 22 aa, Artificial Sequence
  Description of Artificial Sequence: Synthetic peptide
QAVVTQEPSLTVSPGGTVTLTC

SEQ ID NO: 4036 - protein, 30 aa, Artificial Sequence; identical to SEQ ID NO: 832
  Description of Artificial Sequence: Synthetic polypeptide

SEQ ID NO: 4037 - protein, 30 aa, Artificial Sequence; identical to SEQ ID NO: 832
  Description of Artificial Sequence: Synthetic polypeptide

SEQ ID NO: 4038 - protein, 30 aa, Artificial Sequence; identical to SEQ ID NO: 793
  Description of Artificial Sequence: Synthetic polypeptide

SEQ ID NO: 4039 - protein, 30 aa, Artificial Sequence; identical to SEQ ID NO: 794
  Description of Artificial Sequence: Synthetic polypeptide

SEQ ID NO: 4040 - protein, 30 aa, Artificial Sequence; identical to SEQ ID NO: 794
  Description of Artificial Sequence: Synthetic polypeptide

SEQ ID NO: 4041 - protein, 30 aa, Artificial Sequence; identical to SEQ ID NO: 794
  Description of Artificial Sequence: Synthetic polypeptide

SEQ ID NO: 4042 - protein, 30 aa, Artificial Sequence; identical to SEQ ID NO: 794
  Description of Artificial Sequence: Synthetic polypeptide

SEQ ID NO: 4043 - protein, 30 aa, Artificial Sequence; identical to SEQ ID NO: 794
  Description of Artificial Sequence: Synthetic polypeptide

SEQ ID NO: 4044 - protein, 30 aa, Artificial Sequence; identical to SEQ ID NO: 794
  Description of Artificial Sequence: Synthetic polypeptide

SEQ ID NO: 4045 - protein, 30 aa, Artificial Sequence; identical to SEQ ID NO: 794
  Description of Artificial Sequence: Synthetic polypeptide

SEQ ID NO: 4046 - protein, 30 aa, Artificial Sequence; identical to SEQ ID NO: 794
  Description of Artificial Sequence: Synthetic polypeptide

SEQ ID NO: 4047 - protein, 30 aa, Artificial Sequence; identical to SEQ ID NO: 853
  Description of Artificial Sequence: Synthetic polypeptide

SEQ ID NO: 4048 - protein, 30 aa, Artificial Sequence; identical to SEQ ID NO: 853
  Description of Artificial Sequence: Synthetic polypeptide

SEQ ID NO: 4049 - protein, 30 aa, Artificial Sequence
  Description of Artificial Sequence: Synthetic polypeptide
QVQLVQSGAEVKKPGSSVKVSCKASGGTFS

SEQ ID NO: 4050 - protein, 30 aa, Artificial Sequence
  Description of Artificial Sequence: Synthetic polypeptide
VQLLEQSGPELVKPGASVKISCKASGYAFS

SEQ ID NO: 4051 - protein, 30 aa, Artificial Sequence; identical to SEQ ID NO: 4049
  Description of Artificial Sequence: Synthetic polypeptide

SEQ ID NO: 4052 - protein, 30 aa, Artificial Sequence
  Description of Artificial Sequence: Synthetic polypeptide
VQLLEQSGPELVKPGASVKISCKASDYTFS

SEQ ID NO: 4053 - protein, 30 aa, Artificial Sequence; identical to SEQ ID NO: 4049
  Description of Artificial Sequence: Synthetic polypeptide

SEQ ID NO: 4054 - protein, 30 aa, Artificial Sequence; identical to SEQ ID NO: 4050
  Description of Artificial Sequence: Synthetic polypeptide

SEQ ID NO: 4055 - protein, 30 aa, Artificial Sequence; identical to SEQ ID NO: 3145
  Description of Artificial Sequence: Synthetic polypeptide

SEQ ID NO: 4056 - protein, 30 aa, Artificial Sequence; identical to SEQ ID NO: 3145
  Description of Artificial Sequence: Synthetic polypeptide

SEQ ID NO: 4057 - protein, 30 aa, Artificial Sequence
  Description of Artificial Sequence: Synthetic polypeptide
QVQLQQWGAGLLKPSETLSLTCAVYGGSFS

SEQ ID NO: 4058 - protein, 30 aa, Artificial Sequence
  Description of Artificial Sequence: Synthetic polypeptide
QVQLQQWGAGMLKPSETLSLTCAVYGGSFS

SEQ ID NO: 4059 - protein, 30 aa, Artificial Sequence; identical to SEQ ID NO: 853
  Description of Artificial Sequence: Synthetic polypeptide

SEQ ID NO: 4060 - protein, 30 aa, Artificial Sequence
  Description of Artificial Sequence: Synthetic polypeptide
QVQLVESGGGVVQPGRSLRLSCAASGFTFR

SEQ ID NO: 4061 - protein, 12 aa, Artificial Sequence
  Description of Artificial Sequence: Synthetic peptide
RASQSVSSSYLA

SEQ ID NO: 4062 - protein, 12 aa, Artificial Sequence
  Description of Artificial Sequence: Synthetic peptide
RASQSVSSSYLA

SEQ ID NO: 4063 - protein, 17 aa, Artificial Sequence
  Description of Artificial Sequence: Synthetic peptide
KSSQSVLYSSNNKNYLA

SEQ ID NO: 4064 - protein, 17 aa, Artificial Sequence
  Description of Artificial Sequence: Synthetic peptide
KSSQSLLYSSNQKNYLA

SEQ ID NO: 4065 - protein, 11 aa, Artificial Sequence
  Description of Artificial Sequence: Synthetic peptide
RASQSIGSSLH

SEQ ID NO: 4066 - protein, 10 aa, Artificial Sequence
  Description of Artificial Sequence: Synthetic peptide
SASSNVNYIH

SEQ ID NO: 4067 - protein, 11 aa, Artificial Sequence
  Description of Artificial Sequence: Synthetic peptide
RASQGIRNDLG

SEQ ID NO: 4068 - protein, 11 aa, Artificial Sequence
  Description of Artificial Sequence: Synthetic peptide
RASGNIHNYLA

SEQ ID NO: 4069 - protein, 16 aa, Artificial Sequence
  Description of Artificial Sequence: Synthetic peptide
RSSQSLLHSNGYNYLD

SEQ ID NO: 4070 - protein, 16 aa, Artificial Sequence
  Description of Artificial Sequence: Synthetic peptide
RSSQSLLYSNGYNYVD

SEQ ID NO: 4071 - protein, 16 aa, Artificial Sequence
  Description of Artificial Sequence: Synthetic peptide
RSSQSLLHSNGYNYLD

SEQ ID NO: 4072 - protein, 16 aa, Artificial Sequence
  Description of Artificial Sequence: Synthetic peptide
RSSQSLLYSNGYNYLD

SEQ ID NO: 4073 - protein, 12 aa, Artificial Sequence
  Description of Artificial Sequence: Synthetic peptide
RASQSVSSSYLA

SEQ ID NO: 4074 - protein, 12 aa, Artificial Sequence
  Description of Artificial Sequence: Synthetic peptide
RASQSVSSSYLA

SEQ ID NO: 4075 - protein, 14 aa, Artificial Sequence
  Description of Artificial Sequence: Synthetic peptide
ASSTGAVTSGYYPN

SEQ ID NO: 4076 - protein, 14 aa, Artificial Sequence
  Description of Artificial Sequence: Synthetic peptide
GSSTGAVTSGNYPN

SEQ ID NO: 4077 - protein, 14 aa, Artificial Sequence
  Description of Artificial Sequence: Synthetic peptide
GSSTGAVTSGNYPN

SEQ ID NO: 4078 - protein, 14 aa, Artificial Sequence
  Description of Artificial Sequence: Synthetic peptide
GSSTGAVTSGNYPN

SEQ ID NO: 4079 - protein, 14 aa, Artificial Sequence
  Description of Artificial Sequence: Synthetic peptide
GSSTGAVTSGNYPN

SEQ ID NO: 4080 - protein, 14 aa, Artificial Sequence
  Description of Artificial Sequence: Synthetic peptide
GSSTGAVTSGNYPN

SEQ ID NO: 4081 - protein, 14 aa, Artificial Sequence
  Description of Artificial Sequence: Synthetic peptide
GSSTGAVTSGNYPN

SEQ ID NO: 4082 - protein, 14 aa, Artificial Sequence
  Description of Artificial Sequence: Synthetic peptide
GSSTGAVTSGNYPN

SEQ ID NO: 4083 - protein, 14 aa, Artificial Sequence
  Description of Artificial Sequence: Synthetic peptide
GSSTGAVTSGNYPN

SEQ ID NO: 4084 - protein, 14 aa, Artificial Sequence
  Description of Artificial Sequence: Synthetic peptide
GSSTGAVTSGHYPY

SEQ ID NO: 4085 - protein, 14 aa, Artificial Sequence
  Description of Artificial Sequence: Synthetic peptide
GSSTGAVTSGHYPY

SEQ ID NO: 4086 - protein, 5 aa, Artificial Sequence
  Description of Artificial Sequence: Synthetic peptide
SYSMN

SEQ ID NO: 4087 - protein, 5 aa, Artificial Sequence
  Description of Artificial Sequence: Synthetic peptide
TYSMN

SEQ ID NO: 4088 - protein, 5 aa, Artificial Sequence
  Description of Artificial Sequence: Synthetic peptide
GSAMH

SEQ ID NO: 4089 - protein, 5 aa, Artificial Sequence
  Description of Artificial Sequence: Synthetic peptide
KYAMN

SEQ ID NO: 4090 - protein, 5 aa, Artificial Sequence
  Description of Artificial Sequence: Synthetic peptide
KYAMN

SEQ ID NO: 4091 - protein, 5 aa, Artificial Sequence
  Description of Artificial Sequence: Synthetic peptide
KYAMN

SEQ ID NO: 4092 - protein, 5 aa, Artificial Sequence
  Description of Artificial Sequence: Synthetic peptide
KYAMN

SEQ ID NO: 4093 - protein, 5 aa, Artificial Sequence
  Description of Artificial Sequence: Synthetic peptide
KYAMN

SEQ ID NO: 4094 - protein, 5 aa, Artificial Sequence
  Description of Artificial Sequence: Synthetic peptide
KYAMN

SEQ ID NO: 4095 - protein, 5 aa, Artificial Sequence
  Description of Artificial Sequence: Synthetic peptide
KYAMN

SEQ ID NO: 4096 - protein, 5 aa, Artificial Sequence
  Description of Artificial Sequence: Synthetic peptide
KYAMN

SEQ ID NO: 4097 - protein, 5 aa, Artificial Sequence
  Description of Artificial Sequence: Synthetic peptide
SYAMH

SEQ ID NO: 4098 - protein, 5 aa, Artificial Sequence
  Description of Artificial Sequence: Synthetic peptide
SYGMH

SEQ ID NO: 4099 - protein, 5 aa, Artificial Sequence
  Description of Artificial Sequence: Synthetic peptide
SYAIS

SEQ ID NO: 4100 - protein, 5 aa, Artificial Sequence
  Description of Artificial Sequence: Synthetic peptide
KSWMN

SEQ ID NO: 4101 - protein, 5 aa, Artificial Sequence
  Description of Artificial Sequence: Synthetic peptide
SYAIS

SEQ ID NO: 4102 - protein, 5 aa, Artificial Sequence
  Description of Artificial Sequence: Synthetic peptide
KSWMN

SEQ ID NO: 4103 - protein, 5 aa, Artificial Sequence
  Description of Artificial Sequence: Synthetic peptide
SYAIS

SEQ ID NO: 4104 - protein, 5 aa, Artificial Sequence
  Description of Artificial Sequence: Synthetic peptide
SSWMN

SEQ ID NO: 4105 - protein, 5 aa, Artificial Sequence
  Description of Artificial Sequence: Synthetic peptide
SYDIN

SEQ ID NO: 4106 - protein, 5 aa, Artificial Sequence
  Description of Artificial Sequence: Synthetic peptide
SYDIN

SEQ ID NO: 4107 - protein, 5 aa, Artificial Sequence
  Description of Artificial Sequence: Synthetic peptide
GYYWS

SEQ ID NO: 4108 - protein, 5 aa, Artificial Sequence
  Description of Artificial Sequence: Synthetic peptide
GYYWN

SEQ ID NO: 4109 - protein, 5 aa, Artificial Sequence
  Description of Artificial Sequence: Synthetic peptide
SYAMH

SEQ ID NO: 4110 - protein, 5 aa, Artificial Sequence
  Description of Artificial Sequence: Synthetic peptide
SYRMH

SEQ ID NO: 4111 - protein, 15 aa, Artificial Sequence
  Description of Artificial Sequence: Synthetic peptide
WYQQKPGQAPRLLIY

SEQ ID NO: 4112 - protein, 15 aa, Artificial Sequence
  Description of Artificial Sequence: Synthetic peptide
WYQQKPGQAPRLLIY

SEQ ID NO: 4113 - protein, 15 aa, Artificial Sequence
  Description of Artificial Sequence: Synthetic peptide
WYQQKPGQPPKLLIY

SEQ ID NO: 4114 - protein, 15 aa, Artificial Sequence
  Description of Artificial Sequence: Synthetic peptide
WYQQKPGQSPKLLIY

SEQ ID NO: 4115 - protein, 15 aa, Artificial Sequence
  Description of Artificial Sequence: Synthetic peptide
WYQQKPDQSPKLLIK

SEQ ID NO: 4116 - protein, 15 aa, Artificial Sequence
  Description of Artificial Sequence: Synthetic peptide
WYQQKLGSSPKLWIY

SEQ ID NO: 4117 - protein, 15 aa, Artificial Sequence
  Description of Artificial Sequence: Synthetic peptide
WYQQKPGKAPKLLIY

SEQ ID NO: 4118 - protein, 15 aa, Artificial Sequence
  Description of Artificial Sequence: Synthetic peptide
WYQQKQGKSPQLLVY

SEQ ID NO: 4119 - protein, 15 aa, Artificial Sequence
  Description of Artificial Sequence: Synthetic peptide
WYLQKPGQSPQLLIY

SEQ ID NO: 4120 - protein, 15 aa, Artificial Sequence
  Description of Artificial Sequence: Synthetic peptide
WYLQKPGQSPQLLIY

SEQ ID NO: 4121 - protein, 15 aa, Artificial Sequence
  Description of Artificial Sequence: Synthetic peptide
WYLQKPGQSPQLLIY

SEQ ID NO: 4122 - protein, 15 aa, Artificial Sequence
  Description of Artificial Sequence: Synthetic peptide
WYLQKPGQSPQLLIY

SEQ ID NO: 4123 - protein, 15 aa, Artificial Sequence
  Description of Artificial Sequence: Synthetic peptide
WYQQKPGQAPRLLIY

SEQ ID NO: 4124 - protein, 15 aa, Artificial Sequence
  Description of Artificial Sequence: Synthetic peptide
WYQQKPGQAPRLLIY

SEQ ID NO: 4125 - protein, 15 aa, Artificial Sequence
  Description of Artificial Sequence: Synthetic peptide
WFQQKPGQAPRALIY

SEQ ID NO: 4126 - protein, 15 aa, Artificial Sequence
  Description of Artificial Sequence: Synthetic peptide
WVQQKPGQAPRGLIG

SEQ ID NO: 4127 - protein, 15 aa, Artificial Sequence
  Description of Artificial Sequence: Synthetic peptide
WVQQKPGQAPRGLIG

SEQ ID NO: 4128 - protein, 15 aa, Artificial Sequence
  Description of Artificial Sequence: Synthetic peptide
WVQQKPGQAPRGLIG

SEQ ID NO: 4129 - protein, 15 aa, Artificial Sequence
  Description of Artificial Sequence: Synthetic peptide
WVQQKPGQAPRGLIG

SEQ ID NO: 4130 - protein, 15 aa, Artificial Sequence
  Description of Artificial Sequence: Synthetic peptide
WVQQKPGQAPRGLIG

SEQ ID NO: 4131 - protein, 15 aa, Artificial Sequence
  Description of Artificial Sequence: Synthetic peptide
WVQQKPGQAPRGLIG

SEQ ID NO: 4132 - protein, 15 aa, Artificial Sequence
  Description of Artificial Sequence: Synthetic peptide
WVQQKPGQAPRGLIG

SEQ ID NO: 4133 - protein, 15 aa, Artificial Sequence
  Description of Artificial Sequence: Synthetic peptide
WVQQKPGQAPRGLIG

SEQ ID NO: 4134 - protein, 15 aa, Artificial Sequence
  Description of Artificial Sequence: Synthetic peptide
WFQQKPGQAPRTLIY

SEQ ID NO: 4135 - protein, 15 aa, Artificial Sequence
  Description of Artificial Sequence: Synthetic peptide
WFQQKPGQAPRTLIY

SEQ ID NO: 4136 - protein, 14 aa, Artificial Sequence
  Description of Artificial Sequence: Synthetic peptide
WVRQAPGKGLEWVS

SEQ ID NO: 4137 - protein, 14 aa, Artificial Sequence
  Description of Artificial Sequence: Synthetic peptide
WVRQAPGKCLEWVS

SEQ ID NO: 4138 - protein, 14 aa, Artificial Sequence
  Description of Artificial Sequence: Synthetic peptide
WVRQASGKGLEWVG

SEQ ID NO: 4139 - protein, 14 aa, Artificial Sequence
  Description of Artificial Sequence: Synthetic peptide
WVRQAPGKGLEWVA

SEQ ID NO: 4140 - protein, 14 aa, Artificial Sequence
  Description of Artificial Sequence: Synthetic peptide
WVRQAPGKGLEWVA

SEQ ID NO: 4141 - protein, 14 aa, Artificial Sequence
  Description of Artificial Sequence: Synthetic peptide
WVRQAPGKGLEWVA

SEQ ID NO: 4142 - protein, 14 aa, Artificial Sequence
  Description of Artificial Sequence: Synthetic peptide
WVRQAPGKGLEWVA

SEQ ID NO: 4143 - protein, 14 aa, Artificial Sequence
  Description of Artificial Sequence: Synthetic peptide
WVRQAPGKGLEWVA

SEQ ID NO: 4144 - protein, 14 aa, Artificial Sequence
  Description of Artificial Sequence: Synthetic peptide
WVRQAPGKGLEWVA

SEQ ID NO: 4145 - protein, 14 aa, Artificial Sequence
  Description of Artificial Sequence: Synthetic peptide
WVRQAPGKGLEWVA

SEQ ID NO: 4146 - protein, 14 aa, Artificial Sequence
  Description of Artificial Sequence: Synthetic peptide
WVRQAPGKGLEWVA

SEQ ID NO: 4147 - protein, 14 aa, Artificial Sequence
  Description of Artificial Sequence: Synthetic peptide
WVRQAPGKGLEWVA

SEQ ID NO: 4148 - protein, 14 aa, Artificial Sequence
  Description of Artificial Sequence: Synthetic peptide
WVRQAPGKCLEWVA

SEQ ID NO: 4149 - protein, 14 aa, Artificial Sequence
  Description of Artificial Sequence: Synthetic peptide
WVRQAPGQGLEWMG

SEQ ID NO: 4150 - protein, 14 aa, Artificial Sequence
  Description of Artificial Sequence: Synthetic peptide
WVKQRPGKCLEWIG

SEQ ID NO: 4151 - protein, 14 aa, Artificial Sequence
  Description of Artificial Sequence: Synthetic peptide
WVRQAPGQGLEWMG

SEQ ID NO: 4152 - protein, 14 aa, Artificial Sequence
  Description of Artificial Sequence: Synthetic peptide
WVKQRPGECLEWIG

SEQ ID NO: 4153 - protein, 14 aa, Artificial Sequence
  Description of Artificial Sequence: Synthetic peptide
WVRQAPGQGLEWMG

SEQ ID NO: 4154 - protein, 14 aa, Artificial Sequence
  Description of Artificial Sequence: Synthetic peptide
WVKQRPGKCLEWIG

SEQ ID NO: 4155 - protein, 14 aa, Artificial Sequence
  Description of Artificial Sequence: Synthetic peptide
WVRQATGQGLEWMG

SEQ ID NO: 4156 - protein, 14 aa, Artificial Sequence
  Description of Artificial Sequence: Synthetic peptide
WVRQATGQCLEWMG

SEQ ID NO: 4157 - protein, 14 aa, Artificial Sequence
  Description of Artificial Sequence: Synthetic peptide
WIRQPPGKGLEWIG

SEQ ID NO: 4158 - protein, 14 aa, Artificial Sequence
  Description of Artificial Sequence: Synthetic peptide
WIRQPPGKCLEWIG

SEQ ID NO: 4159 - protein, 14 aa, Artificial Sequence
  Description of Artificial Sequence: Synthetic peptide
WVRQAPGKGLEWVA

SEQ ID NO: 4160 - protein, 14 aa, Artificial Sequence
  Description of Artificial Sequence: Synthetic peptide
WVRQAPGKCLEWVA

SEQ ID NO: 4161 - protein, 7 aa, Artificial Sequence
  Description of Artificial Sequence: Synthetic peptide
GASSRAT

SEQ ID NO: 4162 - protein, 7 aa, Artificial Sequence
  Description of Artificial Sequence: Synthetic peptide
GASSRAT

SEQ ID NO: 4163 - protein, 7 aa, Artificial Sequence
  Description of Artificial Sequence: Synthetic peptide
WASTRES

SEQ ID NO: 4164 - protein, 7 aa, Artificial Sequence
  Description of Artificial Sequence: Synthetic peptide
WASTRES

SEQ ID NO: 4165 - protein, 7 aa, Artificial Sequence
  Description of Artificial Sequence: Synthetic peptide
YASQSFS

SEQ ID NO: 4166 - protein, 7 aa, Artificial Sequence
  Description of Artificial Sequence: Synthetic peptide
DTSKLAP

SEQ ID NO: 4167 - protein, 7 aa, Artificial Sequence
  Description of Artificial Sequence: Synthetic peptide
AASSLQS

SEQ ID NO: 4168 - protein, 7 aa, Artificial Sequence
  Description of Artificial Sequence: Synthetic peptide
NAKTLAG

SEQ ID NO: 4169 - protein, 7 aa, Artificial Sequence
  Description of Artificial Sequence: Synthetic peptide
LGSNRAS

SEQ ID NO: 4170 - protein, 7 aa, Artificial Sequence
  Description of Artificial Sequence: Synthetic peptide
LGSNRAS

SEQ ID NO: 4171 - protein, 7 aa, Artificial Sequence
  Description of Artificial Sequence: Synthetic peptide
LGSNRAS

SEQ ID NO: 4172 - protein, 7 aa, Artificial Sequence
  Description of Artificial Sequence: Synthetic peptide
LGSNRAS

SEQ ID NO: 4173 - protein, 7 aa, Artificial Sequence
  Description of Artificial Sequence: Synthetic peptide
GASSRAT

SEQ ID NO: 4174 - protein, 7 aa, Artificial Sequence
  Description of Artificial Sequence: Synthetic peptide
GASSRAT

SEQ ID NO: 4175 - protein, 7 aa, Artificial Sequence
  Description of Artificial Sequence: Synthetic peptide
STSNKHS

SEQ ID NO: 4176 - protein, 7 aa, Artificial Sequence
  Description of Artificial Sequence: Synthetic peptide
GTKFLAP

SEQ ID NO: 4177 - protein, 7 aa, Artificial Sequence
  Description of Artificial Sequence: Synthetic peptide
GTKFLAP

SEQ ID NO: 4178 - protein, 7 aa, Artificial Sequence
  Description of Artificial Sequence: Synthetic peptide
GTKFLAP

SEQ ID NO: 4179 - protein, 7 aa, Artificial Sequence
  Description of Artificial Sequence: Synthetic peptide
GTKFLAP

SEQ ID NO: 4180 - protein, 7 aa, Artificial Sequence
  Description of Artificial Sequence: Synthetic peptide
GTKFLAP

SEQ ID NO: 4181 - protein, 7 aa, Artificial Sequence
  Description of Artificial Sequence: Synthetic peptide
GTKFLAP

SEQ ID NO: 4182 - protein, 7 aa, Artificial Sequence
  Description of Artificial Sequence: Synthetic peptide
GTKFLAP

SEQ ID NO: 4183 - protein, 7 aa, Artificial Sequence
  Description of Artificial Sequence: Synthetic peptide
GTKFLAP

SEQ ID NO: 4184 - protein, 7 aa, Artificial Sequence
  Description of Artificial Sequence: Synthetic peptide
DTSNKHS

SEQ ID NO: 4185 - protein, 7 aa, Artificial Sequence
  Description of Artificial Sequence: Synthetic peptide
DTSNKHS

SEQ ID NO: 4186 - protein, 17 aa, Artificial Sequence
  Description of Artificial Sequence: Synthetic peptide
SISSSSSYIYYADSVKG

SEQ ID NO: 4187 - protein, 17 aa, Artificial Sequence
  Description of Artificial Sequence: Synthetic peptide
SISSSSSYIYYADSVKG

SEQ ID NO: 4188 - protein, 19 aa, Artificial Sequence
  Description of Artificial Sequence: Synthetic peptide
RIRSKANSYATAYAASVKG

SEQ ID NO: 4189 - protein, 19 aa, Artificial Sequence
  Description of Artificial Sequence: Synthetic peptide
RIRSKYNNYATYYADSVKD

SEQ ID NO: 4190 - protein, 19 aa, Artificial Sequence
  Description of Artificial Sequence: Synthetic peptide
RIRSKYNNYATYYADSVKD

SEQ ID NO: 4191 - protein, 19 aa, Artificial Sequence
  Description of Artificial Sequence: Synthetic peptide
RIRSKYNNYATYYADSVKD

SEQ ID NO: 4192 - protein, 19 aa, Artificial Sequence
  Description of Artificial Sequence: Synthetic peptide
RIRSKYNNYATYYADSVKD

SEQ ID NO: 4193 - protein, 19 aa, Artificial Sequence
  Description of Artificial Sequence: Synthetic peptide
RIRSKYNNYATYYADSVKD

SEQ ID NO: 4194 - protein, 19 aa, Artificial Sequence
  Description of Artificial Sequence: Synthetic peptide
RIRSKYNNYATYYADSVKD

SEQ ID NO: 4195 - protein, 19 aa, Artificial Sequence
  Description of Artificial Sequence: Synthetic peptide
RIRSKYNNYATYYADSVKD

SEQ ID NO: 4196 - protein, 19 aa, Artificial Sequence
  Description of Artificial Sequence: Synthetic peptide
RIRSKYNNYATYYADSVKD

SEQ ID NO: 4197 - protein, 17 aa, Artificial Sequence
  Description of Artificial Sequence: Synthetic peptide
VISYDGSNKYYADSVKG

SEQ ID NO: 4198 - protein, 17 aa, Artificial Sequence
  Description of Artificial Sequence: Synthetic peptide
LISYDGSSKYYADSVKG

SEQ ID NO: 4199 - protein, 17 aa, Artificial Sequence
  Description of Artificial Sequence: Synthetic peptide
GIIPIFGTANYAQKFQG

SEQ ID NO: 4200 - protein, 17 aa, Artificial Sequence
  Description of Artificial Sequence: Synthetic peptide
RIYPGDGDTNYNGKFKG

SEQ ID NO: 4201 - protein, 17 aa, Artificial Sequence
  Description of Artificial Sequence: Synthetic peptide
GIIPIFGTANYAQKFQG

SEQ ID NO: 4202 - protein, 17 aa, Artificial Sequence
  Description of Artificial Sequence: Synthetic peptide
RVWPGDGDTTYNEKFKG

SEQ ID NO: 4203 - protein, 17 aa, Artificial Sequence
  Description of Artificial Sequence: Synthetic peptide
GIIPIFGTANYAQKFQG

SEQ ID NO: 4204 - protein, 17 aa, Artificial Sequence
  Description of Artificial Sequence: Synthetic peptide
RIYPGDGDTNYNGKFKD

SEQ ID NO: 4205 - protein, 17 aa, Artificial Sequence
  Description of Artificial Sequence: Synthetic peptide
WMNPNSGNTGYAQKFQG

SEQ ID NO: 4206 - protein, 17 aa, Artificial Sequence
  Description of Artificial Sequence: Synthetic peptide
WMNPNSGNTGYAQKFQG

SEQ ID NO: 4207 - protein, 16 aa, Artificial Sequence
  Description of Artificial Sequence: Synthetic peptide
EINHSGSTNYNPSLKS

SEQ ID NO: 4208 - protein, 16 aa, Artificial Sequence
  Description of Artificial Sequence: Synthetic peptide
EINHSGSTNYNPSLKS

SEQ ID NO: 4209 - protein, 17 aa, Artificial Sequence
  Description of Artificial Sequence: Synthetic peptide
VISYDGSNKYYADSVKG

SEQ ID NO: 4210 - protein, 17 aa, Artificial Sequence
  Description of Artificial Sequence: Synthetic peptide
VISYDGGNKYYADSVKG

SEQ ID NO: 4211 - protein, 32 aa, Artificial Sequence
  Description of Artificial Sequence: Synthetic polypeptide
GIPDRFSGSGSGTDFTLTISRLEPEDFAVYYC

SEQ ID NO: 4212 - protein, 32 aa, Artificial Sequence; identical to SEQ ID NO: 4211
  Description of Artificial Sequence: Synthetic polypeptide

SEQ ID NO: 4213 - protein, 32 aa, Artificial Sequence; identical to SEQ ID NO: 1367
  Description of Artificial Sequence: Synthetic polypeptide

SEQ ID NO: 4214 - protein, 32 aa, Artificial Sequence
  Description of Artificial Sequence: Synthetic polypeptide
GVPDRFTGSGSGTDFTLTISSVKAEDLAVYYC

SEQ ID NO: 4215 - protein, 32 aa, Artificial Sequence
  Description of Artificial Sequence: Synthetic polypeptide
GVPSRFSGSGSGTDFTLTINSLEAEDAATYYC

SEQ ID NO: 4216 - protein, 32 aa, Artificial Sequence
  Description of Artificial Sequence: Synthetic polypeptide
GVPARFSGSGSGTSYSLTISSMEAEDAASYFC

SEQ ID NO: 4217 - protein, 32 aa, Artificial Sequence; identical to SEQ ID NO: 1346
  Description of Artificial Sequence: Synthetic polypeptide

SEQ ID NO: 4218 - protein, 32 aa, Artificial Sequence
  Description of Artificial Sequence: Synthetic polypeptide
GVPSRFSGSGSGTQFSLKINSLQPEDFGSYYC

SEQ ID NO: 4219 - protein, 32 aa, Artificial Sequence; identical to SEQ ID NO: 1372
  Description of Artificial Sequence: Synthetic polypeptide

SEQ ID NO: 4220 - protein, 32 aa, Artificial Sequence
  Description of Artificial Sequence: Synthetic polypeptide
GVPDRFSGSGSGTDFTLKISKVEAEDVGVYYC

SEQ ID NO: 4221 - protein, 32 aa, Artificial Sequence; identical to SEQ ID NO: 1372
  Description of Artificial Sequence: Synthetic polypeptide

SEQ ID NO: 4222 - protein, 32 aa, Artificial Sequence; identical to SEQ ID NO: 1372
  Description of Artificial Sequence: Synthetic polypeptide

SEQ ID NO: 4223 - protein, 32 aa, Artificial Sequence; identical to SEQ ID NO: 4211
  Description of Artificial Sequence: Synthetic polypeptide

SEQ ID NO: 4224 - protein, 32 aa, Artificial Sequence; identical to SEQ ID NO: 4211
  Description of Artificial Sequence: Synthetic polypeptide

SEQ ID NO: 4225 - protein, 32 aa, Artificial Sequence; identical to SEQ ID NO: 1385
  Description of Artificial Sequence: Synthetic polypeptide

SEQ ID NO: 4226 - protein, 32 aa, Artificial Sequence; identical to SEQ ID NO: 1386
  Description of Artificial Sequence: Synthetic polypeptide

SEQ ID NO: 4227 - protein, 32 aa, Artificial Sequence; identical to SEQ ID NO: 1386
  Description of Artificial Sequence: Synthetic polypeptide

SEQ ID NO: 4228 - protein, 32 aa, Artificial Sequence; identical to SEQ ID NO: 1386
  Description of Artificial Sequence: Synthetic polypeptide

SEQ ID NO: 4229 - protein, 32 aa, Artificial Sequence; identical to SEQ ID NO: 1386
  Description of Artificial Sequence: Synthetic polypeptide

SEQ ID NO: 4230 - protein, 32 aa, Artificial Sequence; identical to SEQ ID NO: 1386
  Description of Artificial Sequence: Synthetic polypeptide

SEQ ID NO: 4231 - protein, 32 aa, Artificial Sequence; identical to SEQ ID NO: 1386
  Description of Artificial Sequence: Synthetic polypeptide

SEQ ID NO: 4232 - protein, 32 aa, Artificial Sequence; identical to SEQ ID NO: 1386
  Description of Artificial Sequence: Synthetic polypeptide

SEQ ID NO: 4233 - protein, 32 aa, Artificial Sequence; identical to SEQ ID NO: 1386
  Description of Artificial Sequence: Synthetic polypeptide

SEQ ID NO: 4234 - protein, 32 aa, Artificial Sequence
  Description of Artificial Sequence: Synthetic polypeptide
WTPARFSGSLLGGKAALTLSGAQPEDEAEYYC

SEQ ID NO: 4235 - protein, 32 aa, Artificial Sequence; identical to SEQ ID NO: 4234
  Description of Artificial Sequence: Synthetic polypeptide

SEQ ID NO: 4236 - protein, 32 aa, Artificial Sequence; identical to SEQ ID NO: 1504
  Description of Artificial Sequence: Synthetic polypeptide

SEQ ID NO: 4237 - protein, 32 aa, Artificial Sequence
  Description of Artificial Sequence: Synthetic polypeptide
RFTISRDNAKNSLYLQMNSLRDEDTAVYYCAR

SEQ ID NO: 4238 - protein, 32 aa, Artificial Sequence; identical to SEQ ID NO: 1441
  Description of Artificial Sequence: Synthetic polypeptide

SEQ ID NO: 4239 - protein, 32 aa, Artificial Sequence; identical to SEQ ID NO: 1442
  Description of Artificial Sequence: Synthetic polypeptide

SEQ ID NO: 4240 - protein, 32 aa, Artificial Sequence; identical to SEQ ID NO: 1442
  Description of Artificial Sequence: Synthetic polypeptide

SEQ ID NO: 4241 - protein, 32 aa, Artificial Sequence; identical to SEQ ID NO: 1442
  Description of Artificial Sequence: Synthetic polypeptide

SEQ ID NO: 4242 - protein, 32 aa, Artificial Sequence; identical to SEQ ID NO: 1442
  Description of Artificial Sequence: Synthetic polypeptide

SEQ ID NO: 4243 - protein, 32 aa, Artificial Sequence; identical to SEQ ID NO: 1442
  Description of Artificial Sequence: Synthetic polypeptide

SEQ ID NO: 4244 - protein, 32 aa, Artificial Sequence; identical to SEQ ID NO: 1442
  Description of Artificial Sequence: Synthetic polypeptide

SEQ ID NO: 4245 - protein, 32 aa, Artificial Sequence; identical to SEQ ID NO: 1442
  Description of Artificial Sequence: Synthetic polypeptide

SEQ ID NO: 4246 - protein, 32 aa, Artificial Sequence; identical to SEQ ID NO: 1442
  Description of Artificial Sequence: Synthetic polypeptide

SEQ ID NO: 4247 - protein, 32 aa, Artificial Sequence; identical to SEQ ID NO: 1501
  Description of Artificial Sequence: Synthetic polypeptide

SEQ ID NO: 4248 - protein, 33 aa, Artificial Sequence
  Description of Artificial Sequence: Synthetic polypeptide
RFTISRDNSKNTLDLQMNSLRAEDTAVYYCARS

SEQ ID NO: 4249 - protein, 32 aa, Artificial Sequence
  Description of Artificial Sequence: Synthetic polypeptide
RVTITADKSTSTAYMELSSLRSEDTAVYYCAR

SEQ ID NO: 4250 - protein, 32 aa, Artificial Sequence
  Description of Artificial Sequence: Synthetic polypeptide
KAALTADKSSNTANMQLNSLTSEDSAVYFCAR

SEQ ID NO: 4251 - protein, 32 aa, Artificial Sequence; identical to SEQ ID NO: 4249
  Description of Artificial Sequence: Synthetic polypeptide

SEQ ID NO: 4252 - protein, 32 aa, Artificial Sequence
  Description of Artificial Sequence: Synthetic polypeptide
KATLTADKSSRTAYMQLSSLTSEDSAVYFCAR

SEQ ID NO: 4253 - protein, 32 aa, Artificial Sequence; identical to SEQ ID NO: 4249
  Description of Artificial Sequence: Synthetic polypeptide

SEQ ID NO: 4254 - protein, 32 aa, Artificial Sequence
  Description of Artificial Sequence: Synthetic polypeptide
KATLTADKSSNTAYMQLSSLTSEDSAVYFCAR

SEQ ID NO: 4255 - protein, 32 aa, Artificial Sequence
  Description of Artificial Sequence: Synthetic polypeptide
RVTMTRNTSISTAYMELSSLRSEDTAVYYCAR

SEQ ID NO: 4256 - protein, 32 aa, Artificial Sequence; identical to SEQ ID NO: 4255
  Description of Artificial Sequence: Synthetic polypeptide

SEQ ID NO: 4257 - protein, 32 aa, Artificial Sequence; identical to SEQ ID NO: 1499
  Description of Artificial Sequence: Synthetic polypeptide

SEQ ID NO: 4258 - protein, 32 aa, Artificial Sequence; identical to SEQ ID NO: 1499
  Description of Artificial Sequence: Synthetic polypeptide

SEQ ID NO: 4259 - protein, 32 aa, Artificial Sequence; identical to SEQ ID NO: 1501
  Description of Artificial Sequence: Synthetic polypeptide

SEQ ID NO: 4260 - protein, 32 aa, Artificial Sequence; identical to SEQ ID NO: 1501
  Description of Artificial Sequence: Synthetic polypeptide

SEQ ID NO: 4261 - protein, 9 aa, Artificial Sequence
  Description of Artificial Sequence: Synthetic peptide
QQYGSSPLT

SEQ ID NO: 4262 - protein, 9 aa, Artificial Sequence
  Description of Artificial Sequence: Synthetic peptide
QQYANSPLT

SEQ ID NO: 4263 - protein, 9 aa, Artificial Sequence
  Description of Artificial Sequence: Synthetic peptide
QQYYSTPYT

SEQ ID NO: 4264 - protein, 9 aa, Artificial Sequence
  Description of Artificial Sequence: Synthetic peptide
QQYYSYPYT

SEQ ID NO: 4265 - protein, 9 aa, Artificial Sequence
  Description of Artificial Sequence: Synthetic peptide
HQSSSLPYT

SEQ ID NO: 4266 - protein, 9 aa, Artificial Sequence
  Description of Artificial Sequence: Synthetic peptide
HQWSSYPPT

SEQ ID NO: 4267 - protein, 9 aa, Artificial Sequence
  Description of Artificial Sequence: Synthetic peptide
LQDYNYPYT

SEQ ID NO: 4268 - protein, 9 aa, Artificial Sequence
  Description of Artificial Sequence: Synthetic peptide
QHHYGTPLT

SEQ ID NO: 4269 - protein, 9 aa, Artificial Sequence
  Description of Artificial Sequence: Synthetic peptide
MQALQTPIT

SEQ ID NO: 4270 - protein, 9 aa, Artificial Sequence
  Description of Artificial Sequence: Synthetic peptide
MQALQTPPT

SEQ ID NO: 4271 - protein, 9 aa, Artificial Sequence
  Description of Artificial Sequence: Synthetic peptide
MQALQTPFT

SEQ ID NO: 4272 - protein, 9 aa, Artificial Sequence
  Description of Artificial Sequence: Synthetic peptide
MQALQTPPT

SEQ ID NO: 4273 - protein, 9 aa, Artificial Sequence
  Description of Artificial Sequence: Synthetic peptide
QQYGSSPYT

SEQ ID NO: 4274 - protein, 9 aa, Artificial Sequence
  Description of Artificial Sequence: Synthetic peptide
QQYGSSPLT

SEQ ID NO: 4275 - protein, 10 aa, Artificial Sequence
  Description of Artificial Sequence: Synthetic peptide
LLYYGGAQWV

SEQ ID NO: 4276 - protein, 9 aa, Artificial Sequence
  Description of Artificial Sequence: Synthetic peptide
VLWYSNRWV

SEQ ID NO: 4277 - protein, 9 aa, Artificial Sequence
  Description of Artificial Sequence: Synthetic peptide
VLWYSNRWV

SEQ ID NO: 4278 - protein, 9 aa, Artificial Sequence
  Description of Artificial Sequence: Synthetic peptide
VLWYSNRWV

SEQ ID NO: 4279 - protein, 9 aa, Artificial Sequence
  Description of Artificial Sequence: Synthetic peptide
VLWYSNRWV

SEQ ID NO: 4280 - protein, 9 aa, Artificial Sequence
  Description of Artificial Sequence: Synthetic peptide
VLWYSNRWV

SEQ ID NO: 4281 - protein, 9 aa, Artificial Sequence
  Description of Artificial Sequence: Synthetic peptide
VLWYSNRWV

SEQ ID NO: 4282 - protein, 9 aa, Artificial Sequence
  Description of Artificial Sequence: Synthetic peptide
VLWYSNRWV

SEQ ID NO: 4283 - protein, 9 aa, Artificial Sequence
  Description of Artificial Sequence: Synthetic peptide
VLWYSNRWV

SEQ ID NO: 4284 - protein, 10 aa, Artificial Sequence
  Description of Artificial Sequence: Synthetic peptide
LLSYSGARWV

SEQ ID NO: 4285 - protein, 11 aa, Artificial Sequence
  Description of Artificial Sequence: Synthetic peptide
FLSYSGARNWV

SEQ ID NO: 4286 - protein, 15 aa, Artificial Sequence
  Description of Artificial Sequence: Synthetic peptide
DIVVVVAATAEYFQH

SEQ ID NO: 4287 - protein, 11 aa, Artificial Sequence
  Description of Artificial Sequence: Synthetic peptide
DRIAVATYFDN

SEQ ID NO: 4288 - protein, 13 aa, Artificial Sequence
  Description of Artificial Sequence: Synthetic peptide
ITIFGVVIIYFDY

SEQ ID NO: 4289 - protein, 14 aa, Artificial Sequence
  Description of Artificial Sequence: Synthetic peptide
HGNFGNSYISYWAY

SEQ ID NO: 4290 - protein, 14 aa, Artificial Sequence
  Description of Artificial Sequence: Synthetic peptide
HGNFGNSYISYWAY

SEQ ID NO: 4291 - protein, 14 aa, Artificial Sequence
  Description of Artificial Sequence: Synthetic peptide
HGNFGNSYISYWAY

SEQ ID NO: 4292 - protein, 14 aa, Artificial Sequence
  Description of Artificial Sequence: Synthetic peptide
HGNFGNSYISYWAY

SEQ ID NO: 4293 - protein, 14 aa, Artificial Sequence
  Description of Artificial Sequence: Synthetic peptide
HGNFGNSYISYWAY

SEQ ID NO: 4294 - protein, 14 aa, Artificial Sequence
  Description of Artificial Sequence: Synthetic peptide
HGNFGNSYISYWAY

SEQ ID NO: 4295 - protein, 14 aa, Artificial Sequence
  Description of Artificial Sequence: Synthetic peptide
HGNFGNSYISYWAY

SEQ ID NO: 4296 - protein, 14 aa, Artificial Sequence
  Description of Artificial Sequence: Synthetic peptide
HGNFGNSYISYWAY

SEQ ID NO: 4297 - protein, 21 aa, Artificial Sequence
  Description of Artificial Sequence: Synthetic peptide
YYDYVWGSYRYTYYYYYGMDV

SEQ ID NO: 4298 - protein, 18 aa, Artificial Sequence
  Description of Artificial Sequence: Synthetic peptide
PYDYVWGSYRNYYYGMDV

SEQ ID NO: 4299 - protein, 13 aa, Artificial Sequence
  Description of Artificial Sequence: Synthetic peptide
DIVVVVAATYFDY

SEQ ID NO: 4300 - protein, 10 aa, Artificial Sequence
  Description of Artificial Sequence: Synthetic peptide
DGVFYAPLAY

SEQ ID NO: 4301 - protein, 10 aa, Artificial Sequence
  Description of Artificial Sequence: Synthetic peptide
GYSYGYYFDY

SEQ ID NO: 4302 - protein, 13 aa, Artificial Sequence
  Description of Artificial Sequence: Synthetic peptide
GNYFGSSEAYFDY

SEQ ID NO: 4303 - protein, 10 aa, Artificial Sequence
  Description of Artificial Sequence: Synthetic peptide
VQLERDAFDI

SEQ ID NO: 4304 - protein, 11 aa, Artificial Sequence
  Description of Artificial Sequence: Synthetic peptide
RQLNHVFAMDY

SEQ ID NO: 4305 - protein, 15 aa, Artificial Sequence
  Description of Artificial Sequence: Synthetic peptide
GYSYGYYYYYYGMDV

SEQ ID NO: 4306 - protein, 14 aa, Artificial Sequence
  Description of Artificial Sequence: Synthetic peptide
GGGYSNGYDYGMDV

SEQ ID NO: 4307 - protein, 16 aa, Artificial Sequence
  Description of Artificial Sequence: Synthetic peptide
GYSGYDYYYYYYGMDV

SEQ ID NO: 4308 - protein, 14 aa, Artificial Sequence
  Description of Artificial Sequence: Synthetic peptide
GGGYSYGYDYGMDV

SEQ ID NO: 4309 - protein, 14 aa, Artificial Sequence
  Description of Artificial Sequence: Synthetic peptide
VQLERYYYYYGMDV

SEQ ID NO: 4310 - protein, 12 aa, Artificial Sequence
  Description of Artificial Sequence: Synthetic peptide
EQWPNYYYGMDV

SEQ ID NO: 4311 - protein, 10 aa, Artificial Sequence
  Description of Artificial Sequence: Synthetic peptide
FGGGTKVEIK

SEQ ID NO: 4312 - protein, 10 aa, Artificial Sequence
  Description of Artificial Sequence: Synthetic peptide
FGCGTKVEIK

SEQ ID NO: 4313 - protein, 10 aa, Artificial Sequence
  Description of Artificial Sequence: Synthetic peptide
FGQGTKLEIK

SEQ ID NO: 4314 - protein, 10 aa, Artificial Sequence
  Description of Artificial Sequence: Synthetic peptide
FGCGTKLELK

SEQ ID NO: 4315 - protein, 10 aa, Artificial Sequence
  Description of Artificial Sequence: Synthetic peptide
FGQGTKLEIK

SEQ ID NO: 4316 - protein, 10 aa, Artificial Sequence
  Description of Artificial Sequence: Synthetic peptide
FGCGTKLEIK

SEQ ID NO: 4317 - protein, 10 aa, Artificial Sequence
  Description of Artificial Sequence: Synthetic peptide
FGQGTKLEIK

SEQ ID NO: 4318 - protein, 10 aa, Artificial Sequence
  Description of Artificial Sequence: Synthetic peptide
FGCGTKLELK

SEQ ID NO: 4319 - protein, 10 aa, Artificial Sequence
  Description of Artificial Sequence: Synthetic peptide
FGQGTRLEIK

SEQ ID NO: 4320 - protein, 10 aa, Artificial Sequence
  Description of Artificial Sequence: Synthetic peptide
FGCGTRLEIK

SEQ ID NO: 4321 - protein, 10 aa, Artificial Sequence
  Description of Artificial Sequence: Synthetic peptide
FGPGTKVDIK

SEQ ID NO: 4322 - protein, 10 aa, Artificial Sequence
  Description of Artificial Sequence: Synthetic peptide
FGCGTKVDIK

SEQ ID NO: 4323 - protein, 10 aa, Artificial Sequence
  Description of Artificial Sequence: Synthetic peptide
FGQGTKLEIK

SEQ ID NO: 4324 - protein, 10 aa, Artificial Sequence
  Description of Artificial Sequence: Synthetic peptide
FGCGTKLEIK

SEQ ID NO: 4325 - protein, 10 aa, Artificial Sequence
  Description of Artificial Sequence: Synthetic peptide
FGGGTKLTVL

SEQ ID NO: 4326 - protein, 10 aa, Artificial Sequence
  Description of Artificial Sequence: Synthetic peptide
FGGGTKLTVL

SEQ ID NO: 4327 - protein, 10 aa, Artificial Sequence
  Description of Artificial Sequence: Synthetic peptide
FGGGTKLTVL

SEQ ID NO: 4328 - protein, 10 aa, Artificial Sequence
  Description of Artificial Sequence: Synthetic peptide
FGGGTKLTVL

SEQ ID NO: 4329 - protein, 10 aa, Artificial Sequence
  Description of Artificial Sequence: Synthetic peptide
FGGGTKLTVL

SEQ ID NO: 4330 - protein, 10 aa, Artificial Sequence
  Description of Artificial Sequence: Synthetic peptide
FGGGTKLTVL

SEQ ID NO: 4331 - protein, 10 aa, Artificial Sequence
  Description of Artificial Sequence: Synthetic peptide
FGGGTKLTVL

SEQ ID NO: 4332 - protein, 10 aa, Artificial Sequence
  Description of Artificial Sequence: Synthetic peptide
FGGGTKLTVL

SEQ ID NO: 4333 - protein, 10 aa, Artificial Sequence
  Description of Artificial Sequence: Synthetic peptide
FGGGTKLTVL

SEQ ID NO: 4334 - protein, 10 aa, Artificial Sequence
  Description of Artificial Sequence: Synthetic peptide
FGGGTKLTVL

SEQ ID NO: 4335 - protein, 10 aa, Artificial Sequence
  Description of Artificial Sequence: Synthetic peptide
FGCGTKLTVL

SEQ ID NO: 4336 - protein, 11 aa, Artificial Sequence
  Description of Artificial Sequence: Synthetic peptide
WGQGTLVTVSS

SEQ ID NO: 4337 - protein, 11 aa, Artificial Sequence
  Description of Artificial Sequence: Synthetic peptide
WGQGTLVTVSS

SEQ ID NO: 4338 - protein, 11 aa, Artificial Sequence
  Description of Artificial Sequence: Synthetic peptide
WGQGTLVTVSS

SEQ ID NO: 4339 - protein, 11 aa, Artificial Sequence
  Description of Artificial Sequence: Synthetic peptide
WGQGTLVTVSS

SEQ ID NO: 4340 - protein, 11 aa, Artificial Sequence
  Description of Artificial Sequence: Synthetic peptide
WGQGTLVTVSS

SEQ ID NO: 4341 - protein, 11 aa, Artificial Sequence
  Description of Artificial Sequence: Synthetic peptide
WGQGTLVTVSS

SEQ ID NO: 4342 - protein, 11 aa, Artificial Sequence
  Description of Artificial Sequence: Synthetic peptide
WGQGTLVTVSS

SEQ ID NO: 4343 - protein, 11 aa, Artificial Sequence
  Description of Artificial Sequence: Synthetic peptide
WGQGTLVTVSS

SEQ ID NO: 4344 - protein, 11 aa, Artificial Sequence
  Description of Artificial Sequence: Synthetic peptide
WGQGTLVTVSS

SEQ ID NO: 4345 - protein, 11 aa, Artificial Sequence
  Description of Artificial Sequence: Synthetic peptide
WGQGTLVTVSS

SEQ ID NO: 4346 - protein, 11 aa, Artificial Sequence
  Description of Artificial Sequence: Synthetic peptide
WGQGTLVTVSS

SEQ ID NO: 4347 - protein, 11 aa, Artificial Sequence
  Description of Artificial Sequence: Synthetic peptide
WGQGTTVTVSS

SEQ ID NO: 4348 - protein, 11 aa, Artificial Sequence
  Description of Artificial Sequence: Synthetic peptide
WGQGTTVTVSS

SEQ ID NO: 4349 - protein, 11 aa, Artificial Sequence
  Description of Artificial Sequence: Synthetic peptide
WGQGTLVTVSS

SEQ ID NO: 4350 - protein, 11 aa, Artificial Sequence
  Description of Artificial Sequence: Synthetic peptide
WGQGTLVTVSS

SEQ ID NO: 4351 - protein, 11 aa, Artificial Sequence
  Description of Artificial Sequence: Synthetic peptide
WGQGTLVTVSS

SEQ ID NO: 4352 - protein, 11 aa, Artificial Sequence
  Description of Artificial Sequence: Synthetic peptide
WGQGTRVTVSS

SEQ ID NO: 4353 - protein, 11 aa, Artificial Sequence
  Description of Artificial Sequence: Synthetic peptide
WGQGTMVTVSS

SEQ ID NO: 4354 - protein, 11 aa, Artificial Sequence
  Description of Artificial Sequence: Synthetic peptide
WGQGTSVTVSS

SEQ ID NO: 4355 - protein, 11 aa, Artificial Sequence
  Description of Artificial Sequence: Synthetic peptide
WGQGTTVTVSS

SEQ ID NO: 4356 - protein, 11 aa, Artificial Sequence
  Description of Artificial Sequence: Synthetic peptide
WGQGTTVTVSS

SEQ ID NO: 4357 - protein, 11 aa, Artificial Sequence
  Description of Artificial Sequence: Synthetic peptide
WGQGTTVTVSS

SEQ ID NO: 4358 - protein, 11 aa, Artificial Sequence
  Description of Artificial Sequence: Synthetic peptide
WGQGTTVTVSS

SEQ ID NO: 4359 - protein, 11 aa, Artificial Sequence
  Description of Artificial Sequence: Synthetic peptide
WGQGTTVTVSS

SEQ ID NO: 4360 - protein, 11 aa, Artificial Sequence
  Description of Artificial Sequence: Synthetic peptide
WGQGTTVTVSS

SEQ ID NO: 4361 - protein, 23 aa, Artificial Sequence
  Description of Artificial Sequence: Synthetic peptide
EIVLTQSPGTLSLSPGERATLSC

SEQ ID NO: 4362 - protein, 23 aa, Artificial Sequence
  Description of Artificial Sequence: Synthetic peptide
EIVLTQSPGTLSLSPGERATLSC

SEQ ID NO: 4363 - protein, 23 aa, Artificial Sequence
  Description of Artificial Sequence: Synthetic peptide
DIVMTQSPDSLAVSLGERATINC

SEQ ID NO: 4364 - protein, 23 aa, Artificial Sequence
  Description of Artificial Sequence: Synthetic peptide
ELVMTQSPSSLAVSVGEKITMSC

SEQ ID NO: 4365 - protein, 23 aa, Artificial Sequence
  Description of Artificial Sequence: Synthetic peptide
EIVLTQSPDFQSVTPKEKVTITC

SEQ ID NO: 4366 - protein, 23 aa, Artificial Sequence
  Description of Artificial Sequence: Synthetic peptide
ELVLTQSPAIMSASPGQKVTITC

SEQ ID NO: 4367 - protein, 23 aa, Artificial Sequence
  Description of Artificial Sequence: Synthetic peptide
AIQMTQSPSSLSASVGDRVTITC

SEQ ID NO: 4368 - protein, 23 aa, Artificial Sequence
  Description of Artificial Sequence: Synthetic peptide
ELQMTQSPASLSASVGETVTITC

SEQ ID NO: 4369 - protein, 23 aa, Artificial Sequence
  Description of Artificial Sequence: Synthetic peptide
DIVMTQSPLSLPVTPGEPASISC

SEQ ID NO: 4370 - protein, 23 aa, Artificial Sequence
  Description of Artificial Sequence: Synthetic peptide
DIVMTQSPLSLPVSPGEPASISC

SEQ ID NO: 4371 - protein, 23 aa, Artificial Sequence
  Description of Artificial Sequence: Synthetic peptide
DIVMTQSPLSLPVTPGEPASISC

SEQ ID NO: 4372 - protein, 23 aa, Artificial Sequence
  Description of Artificial Sequence: Synthetic peptide
DIVMTQSPLSLPVTPGEPASISC

SEQ ID NO: 4373 - protein, 23 aa, Artificial Sequence
  Description of Artificial Sequence: Synthetic peptide
EIVLTQSPGTLSLSPGERATLSC

SEQ ID NO: 4374 - protein, 23 aa, Artificial Sequence
  Description of Artificial Sequence: Synthetic peptide
EIVLTQSPGTLSLSPGERATLSC

SEQ ID NO: 4375 - protein, 22 aa, Artificial Sequence
  Description of Artificial Sequence: Synthetic peptide
QTVVTQEPSLTVSPGGTVTLTC

SEQ ID NO: 4376 - protein, 22 aa, Artificial Sequence
  Description of Artificial Sequence: Synthetic peptide
QTVVTQEPSLTVSPGGTVTLTC

SEQ ID NO: 4377 - protein, 22 aa, Artificial Sequence
  Description of Artificial Sequence: Synthetic peptide
QTVVTQEPSLTVSPGGTVTLTC

SEQ ID NO: 4378 - protein, 22 aa, Artificial Sequence
  Description of Artificial Sequence: Synthetic peptide
QTVVTQEPSLTVSPGGTVTLTC

SEQ ID NO: 4379 - protein, 22 aa, Artificial Sequence
  Description of Artificial Sequence: Synthetic peptide
QTVVTQEPSLTVSPGGTVTLTC

SEQ ID NO: 4380 - protein, 22 aa, Artificial Sequence
  Description of Artificial Sequence: Synthetic peptide
QTVVTQEPSLTVSPGGTVTLTC

SEQ ID NO: 4381 - protein, 22 aa, Artificial Sequence
  Description of Artificial Sequence: Synthetic peptide
QTVVTQEPSLTVSPGGTVTLTC

SEQ ID NO: 4382 - protein, 22 aa, Artificial Sequence
  Description of Artificial Sequence: Synthetic peptide
QTVVTQEPSLTVSPGGTVTLTC

SEQ ID NO: 4383 - protein, 22 aa, Artificial Sequence
  Description of Artificial Sequence: Synthetic peptide
QTVVTQEPSLTVSPGGTVTLTC

SEQ ID NO: 4384 - protein, 22 aa, Artificial Sequence
  Description of Artificial Sequence: Synthetic peptide
QAVVTQEPSLTVSPGGTVTLTC

SEQ ID NO: 4385 - protein, 22 aa, Artificial Sequence
  Description of Artificial Sequence: Synthetic peptide
QAVVTQEPSLTVSPGGTVTLTC

SEQ ID NO: 4386 - protein, 30 aa, Artificial Sequence; identical to SEQ ID NO: 832
  Description of Artificial Sequence: Synthetic polypeptide

SEQ ID NO: 4387 - protein, 30 aa, Artificial Sequence; identical to SEQ ID NO: 832
  Description of Artificial Sequence: Synthetic polypeptide

SEQ ID NO: 4388 - protein, 30 aa, Artificial Sequence; identical to SEQ ID NO: 793
  Description of Artificial Sequence: Synthetic polypeptide

SEQ ID NO: 4389 - protein, 30 aa, Artificial Sequence; identical to SEQ ID NO: 794
  Description of Artificial Sequence: Synthetic polypeptide

SEQ ID NO: 4390 - protein, 30 aa, Artificial Sequence; identical to SEQ ID NO: 794
  Description of Artificial Sequence: Synthetic polypeptide

SEQ ID NO: 4391 - protein, 30 aa, Artificial Sequence; identical to SEQ ID NO: 794
  Description of Artificial Sequence: Synthetic polypeptide

SEQ ID NO: 4392 - protein, 30 aa, Artificial Sequence; identical to SEQ ID NO: 794
  Description of Artificial Sequence: Synthetic polypeptide

SEQ ID NO: 4393 - protein, 30 aa, Artificial Sequence; identical to SEQ ID NO: 794
  Description of Artificial Sequence: Synthetic polypeptide

SEQ ID NO: 4394 - protein, 30 aa, Artificial Sequence; identical to SEQ ID NO: 794
  Description of Artificial Sequence: Synthetic polypeptide

SEQ ID NO: 4395 - protein, 30 aa, Artificial Sequence; identical to SEQ ID NO: 794
  Description of Artificial Sequence: Synthetic polypeptide

SEQ ID NO: 4396 - protein, 30 aa, Artificial Sequence; identical to SEQ ID NO: 794
  Description of Artificial Sequence: Synthetic polypeptide

SEQ ID NO: 4397 - protein, 30 aa, Artificial Sequence; identical to SEQ ID NO: 853
  Description of Artificial Sequence: Synthetic polypeptide

SEQ ID NO: 4398 - protein, 30 aa, Artificial Sequence; identical to SEQ ID NO: 853
  Description of Artificial Sequence: Synthetic polypeptide

SEQ ID NO: 4399 - protein, 30 aa, Artificial Sequence; identical to SEQ ID NO: 4049
  Description of Artificial Sequence: Synthetic polypeptide

SEQ ID NO: 4400 - protein, 30 aa, Artificial Sequence; identical to SEQ ID NO: 4050
  Description of Artificial Sequence: Synthetic polypeptide

SEQ ID NO: 4401 - protein, 30 aa, Artificial Sequence; identical to SEQ ID NO: 4049
  Description of Artificial Sequence: Synthetic polypeptide

SEQ ID NO: 4402 - protein, 30 aa, Artificial Sequence; identical to SEQ ID NO: 4052
  Description of Artificial Sequence: Synthetic polypeptide

SEQ ID NO: 4403 - protein, 30 aa, Artificial Sequence; identical to SEQ ID NO: 4049
  Description of Artificial Sequence: Synthetic polypeptide

SEQ ID NO: 4404 - protein, 30 aa, Artificial Sequence; identical to SEQ ID NO: 4050
  Description of Artificial Sequence: Synthetic polypeptide

SEQ ID NO: 4405 - protein, 30 aa, Artificial Sequence; identical to SEQ ID NO: 3145
  Description of Artificial Sequence: Synthetic polypeptide

SEQ ID NO: 4406 - protein, 30 aa, Artificial Sequence; identical to SEQ ID NO: 3145
  Description of Artificial Sequence: Synthetic polypeptide

SEQ ID NO: 4407 - protein, 30 aa, Artificial Sequence; identical to SEQ ID NO: 4057
  Description of Artificial Sequence: Synthetic polypeptide

SEQ ID NO: 4408 - protein, 30 aa, Artificial Sequence; identical to SEQ ID NO: 4058
  Description of Artificial Sequence: Synthetic polypeptide

SEQ ID NO: 4409 - protein, 30 aa, Artificial Sequence; identical to SEQ ID NO: 853
  Description of Artificial Sequence: Synthetic polypeptide

SEQ ID NO: 4410 - protein, 30 aa, Artificial Sequence; identical to SEQ ID NO: 4060
  Description of Artificial Sequence: Synthetic polypeptide

SEQ ID NO: 4411 - protein, 12 aa, Artificial Sequence
  Description of Artificial Sequence: Synthetic peptide
RASQSVSSSYLA

SEQ ID NO: 4412 - protein, 12 aa, Artificial Sequence
  Description of Artificial Sequence: Synthetic peptide
RASQSVSSSYLA

SEQ ID NO: 4413 - protein, 17 aa, Artificial Sequence
  Description of Artificial Sequence: Synthetic peptide
KSSQSVLYSSNNKNYLA

SEQ ID NO: 4414 - protein, 17 aa, Artificial Sequence
  Description of Artificial Sequence: Synthetic peptide
KSSQSLLYSSNQKNYLA

SEQ ID NO: 4415 - protein, 11 aa, Artificial Sequence
  Description of Artificial Sequence: Synthetic peptide
RASQSIGSSLH

SEQ ID NO: 4416 - protein, 10 aa, Artificial Sequence
  Description of Artificial Sequence: Synthetic peptide
SASSNVNYIH

SEQ ID NO: 4417 - protein, 11 aa, Artificial Sequence
  Description of Artificial Sequence: Synthetic peptide
RASQGIRNDLG

SEQ ID NO: 4418 - protein, 11 aa, Artificial Sequence
  Description of Artificial Sequence: Synthetic peptide
RASGNIHNYLA

SEQ ID NO: 4419 - protein, 16 aa, Artificial Sequence
  Description of Artificial Sequence: Synthetic peptide
RSSQSLLHSNGYNYLD

SEQ ID NO: 4420 - protein, 16 aa, Artificial Sequence
  Description of Artificial Sequence: Synthetic peptide
RSSQSLLYSNGYNYVD

SEQ ID NO: 4421 - protein, 16 aa, Artificial Sequence
  Description of Artificial Sequence: Synthetic peptide
RSSQSLLHSNGYNYLD

SEQ ID NO: 4422 - protein, 16 aa, Artificial Sequence
  Description of Artificial Sequence: Synthetic peptide
RSSQSLLYSNGYNYLD

SEQ ID NO: 4423 - protein, 12 aa, Artificial Sequence
  Description of Artificial Sequence: Synthetic peptide
RASQSVSSSYLA

SEQ ID NO: 4424 - protein, 12 aa, Artificial Sequence
  Description of Artificial Sequence: Synthetic peptide
RASQSVSSSYLA

SEQ ID NO: 4425 - protein, 14 aa, Artificial Sequence
  Description of Artificial Sequence: Synthetic peptide
ASSTGAVTSGYYPN

SEQ ID NO: 4426 - protein, 14 aa, Artificial Sequence
  Description of Artificial Sequence: Synthetic peptide
GSSTGAVTSGNYPN

SEQ ID NO: 4427 - protein, 14 aa, Artificial Sequence
  Description of Artificial Sequence: Synthetic peptide
GSSTGAVTSGNYPN

SEQ ID NO: 4428 - protein, 14 aa, Artificial Sequence
  Description of Artificial Sequence: Synthetic peptide
GSSTGAVTSGNYPN

SEQ ID NO: 4429 - protein, 14 aa, Artificial Sequence
  Description of Artificial Sequence: Synthetic peptide
GSSTGAVTSGNYPN

SEQ ID NO: 4430 - protein, 14 aa, Artificial Sequence
  Description of Artificial Sequence: Synthetic peptide
GSSTGAVTSGNYPN

SEQ ID NO: 4431 - protein, 14 aa, Artificial Sequence
  Description of Artificial Sequence: Synthetic peptide
GSSTGAVTSGNYPN

SEQ ID NO: 4432 - protein, 14 aa, Artificial Sequence
  Description of Artificial Sequence: Synthetic peptide
GSSTGAVTSGNYPN

SEQ ID NO: 4433 - protein, 14 aa, Artificial Sequence
  Description of Artificial Sequence: Synthetic peptide
GSSTGAVTSGNYPN

SEQ ID NO: 4434 - protein, 14 aa, Artificial Sequence
  Description of Artificial Sequence: Synthetic peptide
GSSTGAVTSGHYPY

SEQ ID NO: 4435 - protein, 14 aa, Artificial Sequence
  Description of Artificial Sequence: Synthetic peptide
GSSTGAVTSGHYPY

SEQ ID NO: 4436 - protein, 5 aa, Artificial Sequence
  Description of Artificial Sequence: Synthetic peptide
SYSMN

SEQ ID NO: 4437 - protein, 5 aa, Artificial Sequence
  Description of Artificial Sequence: Synthetic peptide
TYSMN

SEQ ID NO: 4438 - protein, 5 aa, Artificial Sequence
  Description of Artificial Sequence: Synthetic peptide
GSAMH

SEQ ID NO: 4439 - protein, 5 aa, Artificial Sequence
  Description of Artificial Sequence: Synthetic peptide
KYAMN

SEQ ID NO: 4440 - protein, 5 aa, Artificial Sequence
  Description of Artificial Sequence: Synthetic peptide
KYAMN

SEQ ID NO: 4441 - protein, 5 aa, Artificial Sequence
  Description of Artificial Sequence: Synthetic peptide
KYAMN

SEQ ID NO: 4442 - protein, 5 aa, Artificial Sequence
  Description of Artificial Sequence: Synthetic peptide
KYAMN

SEQ ID NO: 4443 - protein, 5 aa, Artificial Sequence
  Description of Artificial Sequence: Synthetic peptide
KYAMN

SEQ ID NO: 4444 - protein, 5 aa, Artificial Sequence
  Description of Artificial Sequence: Synthetic peptide
KYAMN

SEQ ID NO: 4445 - protein, 5 aa, Artificial Sequence
  Description of Artificial Sequence: Synthetic peptide
KYAMN

SEQ ID NO: 4446 - protein, 5 aa, Artificial Sequence
  Description of Artificial Sequence: Synthetic peptide
KYAMN

SEQ ID NO: 4447 - protein, 5 aa, Artificial Sequence
  Description of Artificial Sequence: Synthetic peptide
SYAMH

SEQ ID NO: 4448 - protein, 5 aa, Artificial Sequence
  Description of Artificial Sequence: Synthetic peptide
SYGMH

SEQ ID NO: 4449 - protein, 5 aa, Artificial Sequence
  Description of Artificial Sequence: Synthetic peptide
SYAIS

SEQ ID NO: 4450 - protein, 5 aa, Artificial Sequence
  Description of Artificial Sequence: Synthetic peptide
KSWMN

SEQ ID NO: 4451 - protein, 5 aa, Artificial Sequence
  Description of Artificial Sequence: Synthetic peptide
SYAIS

SEQ ID NO: 4452 - protein, 5 aa, Artificial Sequence
  Description of Artificial Sequence: Synthetic peptide
KSWMN

SEQ ID NO: 4453 - protein, 5 aa, Artificial Sequence
  Description of Artificial Sequence: Synthetic peptide
SYAIS

SEQ ID NO: 4454 - protein, 5 aa, Artificial Sequence
  Description of Artificial Sequence: Synthetic peptide
SSWMN

SEQ ID NO: 4455 - protein, 5 aa, Artificial Sequence
  Description of Artificial Sequence: Synthetic peptide
SYDIN

SEQ ID NO: 4456 - protein, 5 aa, Artificial Sequence
  Description of Artificial Sequence: Synthetic peptide
SYDIN

SEQ ID NO: 4457 - protein, 5 aa, Artificial Sequence
  Description of Artificial Sequence: Synthetic peptide
GYYWS

SEQ ID NO: 4458 - protein, 5 aa, Artificial Sequence
  Description of Artificial Sequence: Synthetic peptide
GYYWN

SEQ ID NO: 4459 - protein, 5 aa, Artificial Sequence
  Description of Artificial Sequence: Synthetic peptide
SYAMH

SEQ ID NO: 4460 - protein, 5 aa, Artificial Sequence
  Description of Artificial Sequence: Synthetic peptide
SYRMH

SEQ ID NO: 4461 - protein, 15 aa, Artificial Sequence
  Description of Artificial Sequence: Synthetic peptide
WYQQKPGQAPRLLIY

SEQ ID NO: 4462 - protein, 15 aa, Artificial Sequence
  Description of Artificial Sequence: Synthetic peptide
WYQQKPGQAPRLLIY

SEQ ID NO: 4463 - protein, 15 aa, Artificial Sequence
  Description of Artificial Sequence: Synthetic peptide
WYQQKPGQPPKLLIY

SEQ ID NO: 4464 - protein, 15 aa, Artificial Sequence
  Description of Artificial Sequence: Synthetic peptide
WYQQKPGQSPKLLIY

SEQ ID NO: 4465 - protein, 15 aa, Artificial Sequence
  Description of Artificial Sequence: Synthetic peptide
WYQQKPDQSPKLLIK

SEQ ID NO: 4466 - protein, 15 aa, Artificial Sequence
  Description of Artificial Sequence: Synthetic peptide
WYQQKLGSSPKLWIY

SEQ ID NO: 4467 - protein, 15 aa, Artificial Sequence
  Description of Artificial Sequence: Synthetic peptide
WYQQKPGKAPKLLIY

SEQ ID NO: 4468 - protein, 15 aa, Artificial Sequence
  Description of Artificial Sequence: Synthetic peptide
WYQQKQGKSPQLLVY

SEQ ID NO: 4469 - protein, 15 aa, Artificial Sequence
  Description of Artificial Sequence: Synthetic peptide
WYLQKPGQSPQLLIY

SEQ ID NO: 4470 - protein, 15 aa, Artificial Sequence
  Description of Artificial Sequence: Synthetic peptide
WYLQKPGQSPQLLIY

SEQ ID NO: 4471 - protein, 15 aa, Artificial Sequence
  Description of Artificial Sequence: Synthetic peptide
WYLQKPGQSPQLLIY

SEQ ID NO: 4472 - protein, 15 aa, Artificial Sequence
  Description of Artificial Sequence: Synthetic peptide
WYLQKPGQSPQLLIY

SEQ ID NO: 4473 - protein, 15 aa, Artificial Sequence
  Description of Artificial Sequence: Synthetic peptide
WYQQKPGQAPRLLIY

SEQ ID NO: 4474 - protein, 15 aa, Artificial Sequence
  Description of Artificial Sequence: Synthetic peptide
WYQQKPGQAPRLLIY

SEQ ID NO: 4475 - protein, 15 aa, Artificial Sequence
  Description of Artificial Sequence: Synthetic peptide
WFQQKPGQAPRALIY

SEQ ID NO: 4476 - protein, 15 aa, Artificial Sequence
  Description of Artificial Sequence: Synthetic peptide
WVQQKPGQAPRGLIG

SEQ ID NO: 4477 - protein, 15 aa, Artificial Sequence
  Description of Artificial Sequence: Synthetic peptide
WVQQKPGQAPRGLIG

SEQ ID NO: 4478 - protein, 15 aa, Artificial Sequence
  Description of Artificial Sequence: Synthetic peptide
WVQQKPGQAPRGLIG

SEQ ID NO: 4479 - protein, 15 aa, Artificial Sequence
  Description of Artificial Sequence: Synthetic peptide
WVQQKPGQAPRGLIG

SEQ ID NO: 4480 - protein, 15 aa, Artificial Sequence
  Description of Artificial Sequence: Synthetic peptide
WVQQKPGQAPRGLIG

SEQ ID NO: 4481 - protein, 15 aa, Artificial Sequence
  Description of Artificial Sequence: Synthetic peptide
WVQQKPGQAPRGLIG

SEQ ID NO: 4482 - protein, 15 aa, Artificial Sequence
  Description of Artificial Sequence: Synthetic peptide
WVQQKPGQAPRGLIG

SEQ ID NO: 4483 - protein, 15 aa, Artificial Sequence
  Description of Artificial Sequence: Synthetic peptide
WVQQKPGQAPRGLIG

SEQ ID NO: 4484 - protein, 15 aa, Artificial Sequence
  Description of Artificial Sequence: Synthetic peptide
WFQQKPGQAPRTLIY

SEQ ID NO: 4485 - protein, 15 aa, Artificial Sequence
  Description of Artificial Sequence: Synthetic peptide
WFQQKPGQAPRTLIY

SEQ ID NO: 4486 - protein, 14 aa, Artificial Sequence
  Description of Artificial Sequence: Synthetic peptide
WVRQAPGKGLEWVS

SEQ ID NO: 4487 - protein, 14 aa, Artificial Sequence
  Description of Artificial Sequence: Synthetic peptide
WVRQAPGKCLEWVS

SEQ ID NO: 4488 - protein, 14 aa, Artificial Sequence
  Description of Artificial Sequence: Synthetic peptide
WVRQASGKGLEWVG

SEQ ID NO: 4489 - protein, 14 aa, Artificial Sequence
  Description of Artificial Sequence: Synthetic peptide
WVRQAPGKGLEWVA

SEQ ID NO: 4490 - protein, 14 aa, Artificial Sequence
  Description of Artificial Sequence: Synthetic peptide
WVRQAPGKGLEWVA

SEQ ID NO: 4491 - protein, 14 aa, Artificial Sequence
  Description of Artificial Sequence: Synthetic peptide
WVRQAPGKGLEWVA

SEQ ID NO: 4492 - protein, 14 aa, Artificial Sequence
  Description of Artificial Sequence: Synthetic peptide
WVRQAPGKGLEWVA

SEQ ID NO: 4493 - protein, 14 aa, Artificial Sequence
  Description of Artificial Sequence: Synthetic peptide
WVRQAPGKGLEWVA

SEQ ID NO: 4494 - protein, 14 aa, Artificial Sequence
  Description of Artificial Sequence: Synthetic peptide
WVRQAPGKGLEWVA

SEQ ID NO: 4495 - protein, 14 aa, Artificial Sequence
  Description of Artificial Sequence: Synthetic peptide
WVRQAPGKGLEWVA

SEQ ID NO: 4496 - protein, 14 aa, Artificial Sequence
  Description of Artificial Sequence: Synthetic peptide
WVRQAPGKGLEWVA

SEQ ID NO: 4497 - protein, 14 aa, Artificial Sequence
  Description of Artificial Sequence: Synthetic peptide
WVRQAPGKGLEWVA

SEQ ID NO: 4498 - protein, 14 aa, Artificial Sequence
  Description of Artificial Sequence: Synthetic peptide
WVRQAPGKCLEWVA

SEQ ID NO: 4499 - protein, 14 aa, Artificial Sequence
  Description of Artificial Sequence: Synthetic peptide
WVRQAPGQGLEWMG

SEQ ID NO: 4500 - protein, 14 aa, Artificial Sequence
  Description of Artificial Sequence: Synthetic peptide
WVKQRPGKCLEWIG

SEQ ID NO: 4501 - protein, 14 aa, Artificial Sequence
  Description of Artificial Sequence: Synthetic peptide
WVRQAPGQGLEWMG

SEQ ID NO: 4502 - protein, 14 aa, Artificial Sequence
  Description of Artificial Sequence: Synthetic peptide
WVKQRPGECLEWIG

SEQ ID NO: 4503 - protein, 14 aa, Artificial Sequence
  Description of Artificial Sequence: Synthetic peptide
WVRQAPGQGLEWMG

SEQ ID NO: 4504 - protein, 14 aa, Artificial Sequence
  Description of Artificial Sequence: Synthetic peptide
WVKQRPGKCLEWIG

SEQ ID NO: 4505 - protein, 14 aa, Artificial Sequence
  Description of Artificial Sequence: Synthetic peptide
WVRQATGQGLEWMG

SEQ ID NO: 4506 - protein, 14 aa, Artificial Sequence
  Description of Artificial Sequence: Synthetic peptide
WVRQATGQCLEWMG

SEQ ID NO: 4507 - protein, 14 aa, Artificial Sequence
  Description of Artificial Sequence: Synthetic peptide
WIRQPPGKGLEWIG

SEQ ID NO: 4508 - protein, 14 aa, Artificial Sequence
  Description of Artificial Sequence: Synthetic peptide
WIRQPPGKCLEWIG

SEQ ID NO: 4509 - protein, 14 aa, Artificial Sequence
  Description of Artificial Sequence: Synthetic peptide
WVRQAPGKGLEWVA

SEQ ID NO: 4510 - protein, 14 aa, Artificial Sequence
  Description of Artificial Sequence: Synthetic peptide
WVRQAPGKCLEWVA

SEQ ID NO: 4511 - protein, 7 aa, Artificial Sequence
  Description of Artificial Sequence: Synthetic peptide
GASSRAT

SEQ ID NO: 4512 - protein, 7 aa, Artificial Sequence
  Description of Artificial Sequence: Synthetic peptide
GASSRAT

SEQ ID NO: 4513 - protein, 7 aa, Artificial Sequence
  Description of Artificial Sequence: Synthetic peptide
WASTRES

SEQ ID NO: 4514 - protein, 7 aa, Artificial Sequence
  Description of Artificial Sequence: Synthetic peptide
WASTRES

SEQ ID NO: 4515 - protein, 7 aa, Artificial Sequence
  Description of Artificial Sequence: Synthetic peptide
YASQSFS

SEQ ID NO: 4516 - protein, 7 aa, Artificial Sequence
  Description of Artificial Sequence: Synthetic peptide
DTSKLAP

SEQ ID NO: 4517 - protein, 7 aa, Artificial Sequence
  Description of Artificial Sequence: Synthetic peptide
AASSLQS

SEQ ID NO: 4518 - protein, 7 aa, Artificial Sequence
  Description of Artificial Sequence: Synthetic peptide
NAKTLAG

SEQ ID NO: 4519 - protein, 7 aa, Artificial Sequence
  Description of Artificial Sequence: Synthetic peptide
LGSNRAS

SEQ ID NO: 4520 - protein, 7 aa, Artificial Sequence
  Description of Artificial Sequence: Synthetic peptide
LGSNRAS

SEQ ID NO: 4521 - protein, 7 aa, Artificial Sequence
  Description of Artificial Sequence: Synthetic peptide
LGSNRAS

SEQ ID NO: 4522 - protein, 7 aa, Artificial Sequence
  Description of Artificial Sequence: Synthetic peptide
LGSNRAS

SEQ ID NO: 4523 - protein, 7 aa, Artificial Sequence
  Description of Artificial Sequence: Synthetic peptide
GASSRAT

SEQ ID NO: 4524 - protein, 7 aa, Artificial Sequence
  Description of Artificial Sequence: Synthetic peptide
GASSRAT

SEQ ID NO: 4525 - protein, 7 aa, Artificial Sequence
  Description of Artificial Sequence: Synthetic peptide
STSNKHS

SEQ ID NO: 4526 - protein, 7 aa, Artificial Sequence
  Description of Artificial Sequence: Synthetic peptide
GTKFLAP

SEQ ID NO: 4527 - protein, 7 aa, Artificial Sequence
  Description of Artificial Sequence: Synthetic peptide
GTKFLAP

SEQ ID NO: 4528 - protein, 7 aa, Artificial Sequence
  Description of Artificial Sequence: Synthetic peptide
GTKFLAP

SEQ ID NO: 4529 - protein, 7 aa, Artificial Sequence
  Description of Artificial Sequence: Synthetic peptide
GTKFLAP

SEQ ID NO: 4530 - protein, 7 aa, Artificial Sequence
  Description of Artificial Sequence: Synthetic peptide
GTKFLAP

SEQ ID NO: 4531 - protein, 7 aa, Artificial Sequence
  Description of Artificial Sequence: Synthetic peptide
GTKFLAP

SEQ ID NO: 4532 - protein, 7 aa, Artificial Sequence
  Description of Artificial Sequence: Synthetic peptide
GTKFLAP

SEQ ID NO: 4533 - protein, 7 aa, Artificial Sequence
  Description of Artificial Sequence: Synthetic peptide
GTKFLAP

SEQ ID NO: 4534 - protein, 7 aa, Artificial Sequence
  Description of Artificial Sequence: Synthetic peptide
DTSNKHS

SEQ ID NO: 4535 - protein, 7 aa, Artificial Sequence
  Description of Artificial Sequence: Synthetic peptide
DTSNKHS

SEQ ID NO: 4536 - protein, 17 aa, Artificial Sequence
  Description of Artificial Sequence: Synthetic peptide
SISSSSSYIYYADSVKG

SEQ ID NO: 4537 - protein, 17 aa, Artificial Sequence
  Description of Artificial Sequence: Synthetic peptide
SISSSSSYIYYADSVKG

SEQ ID NO: 4538 - protein, 19 aa, Artificial Sequence
  Description of Artificial Sequence: Synthetic peptide
RIRSKANSYATAYAASVKG

SEQ ID NO: 4539 - protein, 19 aa, Artificial Sequence
  Description of Artificial Sequence: Synthetic peptide
RIRSKYNNYATYYADSVKD

SEQ ID NO: 4540 - protein, 19 aa, Artificial Sequence
  Description of Artificial Sequence: Synthetic peptide
RIRSKYNNYATYYADSVKD

SEQ ID NO: 4541 - protein, 19 aa, Artificial Sequence
  Description of Artificial Sequence: Synthetic peptide
RIRSKYNNYATYYADSVKD

SEQ ID NO: 4542 - protein, 19 aa, Artificial Sequence
  Description of Artificial Sequence: Synthetic peptide
RIRSKYNNYATYYADSVKD

SEQ ID NO: 4543 - protein, 19 aa, Artificial Sequence
  Description of Artificial Sequence: Synthetic peptide
RIRSKYNNYATYYADSVKD

SEQ ID NO: 4544 - protein, 19 aa, Artificial Sequence
  Description of Artificial Sequence: Synthetic peptide
RIRSKYNNYATYYADSVKD

SEQ ID NO: 4545 - protein, 19 aa, Artificial Sequence
  Description of Artificial Sequence: Synthetic peptide
RIRSKYNNYATYYADSVKD

SEQ ID NO: 4546 - protein, 19 aa, Artificial Sequence
  Description of Artificial Sequence: Synthetic peptide
RIRSKYNNYATYYADSVKD

SEQ ID NO: 4547 - protein, 17 aa, Artificial Sequence
  Description of Artificial Sequence: Synthetic peptide
VISYDGSNKYYADSVKG

SEQ ID NO: 4548 - protein, 17 aa, Artificial Sequence
  Description of Artificial Sequence: Synthetic peptide
LISYDGSSKYYADSVKG

SEQ ID NO: 4549 - protein, 17 aa, Artificial Sequence
  Description of Artificial Sequence: Synthetic peptide
GIIPIFGTANYAQKFQG

SEQ ID NO: 4550 - protein, 17 aa, Artificial Sequence
  Description of Artificial Sequence: Synthetic peptide
RIYPGDGDTNYNGKFKG

SEQ ID NO: 4551 - protein, 17 aa, Artificial Sequence
  Description of Artificial Sequence: Synthetic peptide
GIIPIFGTANYAQKFQG

SEQ ID NO: 4552 - protein, 17 aa, Artificial Sequence
  Description of Artificial Sequence: Synthetic peptide
RVWPGDGDTTYNEKFKG

SEQ ID NO: 4553 - protein, 17 aa, Artificial Sequence
  Description of Artificial Sequence: Synthetic peptide
GIIPIFGTANYAQKFQG

SEQ ID NO: 4554 - protein, 17 aa, Artificial Sequence
  Description of Artificial Sequence: Synthetic peptide
RIYPGDGDTNYNGKFKD

SEQ ID NO: 4555 - protein, 17 aa, Artificial Sequence
  Description of Artificial Sequence: Synthetic peptide
WMNPNSGNTGYAQKFQG

SEQ ID NO: 4556 - protein, 17 aa, Artificial Sequence
  Description of Artificial Sequence: Synthetic peptide
WMNPNSGNTGYAQKFQG

SEQ ID NO: 4557 - protein, 16 aa, Artificial Sequence
  Description of Artificial Sequence: Synthetic peptide
EINHSGSTNYNPSLKS

SEQ ID NO: 4558 - protein, 16 aa, Artificial Sequence
  Description of Artificial Sequence: Synthetic peptide
EINHSGSTNYNPSLKS

SEQ ID NO: 4559 - protein, 17 aa, Artificial Sequence
  Description of Artificial Sequence: Synthetic peptide
VISYDGSNKYYADSVKG

SEQ ID NO: 4560 - protein, 17 aa, Artificial Sequence
  Description of Artificial Sequence: Synthetic peptide
VISYDGGNKYYADSVKG

SEQ ID NO: 4561 - protein, 32 aa, Artificial Sequence; identical to SEQ ID NO: 4211
  Description of Artificial Sequence: Synthetic polypeptide

SEQ ID NO: 4562 - protein, 32 aa, Artificial Sequence; identical to SEQ ID NO: 4211
  Description of Artificial Sequence: Synthetic polypeptide

SEQ ID NO: 4563 - protein, 32 aa, Artificial Sequence; identical to SEQ ID NO: 1367
  Description of Artificial Sequence: Synthetic polypeptide

SEQ ID NO: 4564 - protein, 32 aa, Artificial Sequence; identical to SEQ ID NO: 4214
  Description of Artificial Sequence: Synthetic polypeptide

SEQ ID NO: 4565 - protein, 32 aa, Artificial Sequence; identical to SEQ ID NO: 4215
  Description of Artificial Sequence: Synthetic polypeptide

SEQ ID NO: 4566 - protein, 32 aa, Artificial Sequence; identical to SEQ ID NO: 4216
  Description of Artificial Sequence: Synthetic polypeptide

SEQ ID NO: 4567 - protein, 32 aa, Artificial Sequence; identical to SEQ ID NO: 1346
  Description of Artificial Sequence: Synthetic polypeptide

SEQ ID NO: 4568 - protein, 32 aa, Artificial Sequence; identical to SEQ ID NO: 4218
  Description of Artificial Sequence: Synthetic polypeptide

SEQ ID NO: 4569 - protein, 32 aa, Artificial Sequence; identical to SEQ ID NO: 1372
  Description of Artificial Sequence: Synthetic polypeptide

SEQ ID NO: 4570 - protein, 32 aa, Artificial Sequence; identical to SEQ ID NO: 4220
  Description of Artificial Sequence: Synthetic polypeptide

SEQ ID NO: 4571 - protein, 32 aa, Artificial Sequence; identical to SEQ ID NO: 1372
  Description of Artificial Sequence: Synthetic polypeptide

SEQ ID NO: 4572 - protein, 32 aa, Artificial Sequence; identical to SEQ ID NO: 1372
  Description of Artificial Sequence: Synthetic polypeptide

SEQ ID NO: 4573 - protein, 32 aa, Artificial Sequence; identical to SEQ ID NO: 4211
  Description of Artificial Sequence: Synthetic polypeptide

SEQ ID NO: 4574 - protein, 32 aa, Artificial Sequence; identical to SEQ ID NO: 4211
  Description of Artificial Sequence: Synthetic polypeptide

SEQ ID NO: 4575 - protein, 32 aa, Artificial Sequence; identical to SEQ ID NO: 1385
  Description of Artificial Sequence: Synthetic polypeptide

SEQ ID NO: 4576 - protein, 32 aa, Artificial Sequence; identical to SEQ ID NO: 1386
  Description of Artificial Sequence: Synthetic polypeptide

SEQ ID NO: 4577 - protein, 32 aa, Artificial Sequence; identical to SEQ ID NO: 1386
  Description of Artificial Sequence: Synthetic polypeptide

SEQ ID NO: 4578 - protein, 32 aa, Artificial Sequence; identical to SEQ ID NO: 1386
  Description of Artificial Sequence: Synthetic polypeptide

SEQ ID NO: 4579 - protein, 32 aa, Artificial Sequence; identical to SEQ ID NO: 1386
  Description of Artificial Sequence: Synthetic polypeptide

SEQ ID NO: 4580 - protein, 32 aa, Artificial Sequence; identical to SEQ ID NO: 1386
  Description of Artificial Sequence: Synthetic polypeptide

SEQ ID NO: 4581 - protein, 32 aa, Artificial Sequence; identical to SEQ ID NO: 1386
  Description of Artificial Sequence: Synthetic polypeptide

SEQ ID NO: 4582 - protein, 32 aa, Artificial Sequence; identical to SEQ ID NO: 1386
  Description of Artificial Sequence: Synthetic polypeptide

SEQ ID NO: 4583 - protein, 32 aa, Artificial Sequence; identical to SEQ ID NO: 1386
  Description of Artificial Sequence: Synthetic polypeptide

SEQ ID NO: 4584 - protein, 32 aa, Artificial Sequence; identical to SEQ ID NO: 4234
  Description of Artificial Sequence: Synthetic polypeptide

SEQ ID NO: 4585 - protein, 32 aa, Artificial Sequence; identical to SEQ ID NO: 4234
  Description of Artificial Sequence: Synthetic polypeptide

SEQ ID NO: 4586 - protein, 32 aa, Artificial Sequence; identical to SEQ ID NO: 1504
  Description of Artificial Sequence: Synthetic polypeptide

SEQ ID NO: 4587 - protein, 32 aa, Artificial Sequence; identical to SEQ ID NO: 4237
  Description of Artificial Sequence: Synthetic polypeptide

SEQ ID NO: 4588 - protein, 32 aa, Artificial Sequence; identical to SEQ ID NO: 1441
  Description of Artificial Sequence: Synthetic polypeptide

SEQ ID NO: 4589 - protein, 32 aa, Artificial Sequence; identical to SEQ ID NO: 1442
  Description of Artificial Sequence: Synthetic polypeptide

SEQ ID NO: 4590 - protein, 32 aa, Artificial Sequence; identical to SEQ ID NO: 1442
  Description of Artificial Sequence: Synthetic polypeptide

SEQ ID NO: 4591 - protein, 32 aa, Artificial Sequence; identical to SEQ ID NO: 1442
  Description of Artificial Sequence: Synthetic polypeptide

SEQ ID NO: 4592 - protein, 32 aa, Artificial Sequence; identical to SEQ ID NO: 1442
  Description of Artificial Sequence: Synthetic polypeptide

SEQ ID NO: 4593 - protein, 32 aa, Artificial Sequence; identical to SEQ ID NO: 1442
  Description of Artificial Sequence: Synthetic polypeptide

SEQ ID NO: 4594 - protein, 32 aa, Artificial Sequence; identical to SEQ ID NO: 1442
  Description of Artificial Sequence: Synthetic polypeptide

SEQ ID NO: 4595 - protein, 32 aa, Artificial Sequence; identical to SEQ ID NO: 1442
  Description of Artificial Sequence: Synthetic polypeptide

SEQ ID NO: 4596 - protein, 32 aa, Artificial Sequence; identical to SEQ ID NO: 1442
  Description of Artificial Sequence: Synthetic polypeptide

SEQ ID NO: 4597 - protein, 32 aa, Artificial Sequence; identical to SEQ ID NO: 1501
  Description of Artificial Sequence: Synthetic polypeptide

SEQ ID NO: 4598 - protein, 33 aa, Artificial Sequence; identical to SEQ ID NO: 4248
  Description of Artificial Sequence: Synthetic polypeptide

SEQ ID NO: 4599 - protein, 32 aa, Artificial Sequence; identical to SEQ ID NO: 4249
  Description of Artificial Sequence: Synthetic polypeptide

SEQ ID NO: 4600 - protein, 32 aa, Artificial Sequence; identical to SEQ ID NO: 4250
  Description of Artificial Sequence: Synthetic polypeptide

SEQ ID NO: 4601 - protein, 32 aa, Artificial Sequence; identical to SEQ ID NO: 4249
  Description of Artificial Sequence: Synthetic polypeptide

SEQ ID NO: 4602 - protein, 32 aa, Artificial Sequence; identical to SEQ ID NO: 4252
  Description of Artificial Sequence: Synthetic polypeptide

SEQ ID NO: 4603 - protein, 32 aa, Artificial Sequence; identical to SEQ ID NO: 4249
  Description of Artificial Sequence: Synthetic polypeptide

SEQ ID NO: 4604 - protein, 32 aa, Artificial Sequence; identical to SEQ ID NO: 4254
  Description of Artificial Sequence: Synthetic polypeptide

SEQ ID NO: 4605 - protein, 32 aa, Artificial Sequence; identical to SEQ ID NO: 4255
  Description of Artificial Sequence: Synthetic polypeptide

SEQ ID NO: 4606 - protein, 32 aa, Artificial Sequence; identical to SEQ ID NO: 4255
  Description of Artificial Sequence: Synthetic polypeptide

SEQ ID NO: 4607 - protein, 32 aa, Artificial Sequence; identical to SEQ ID NO: 1499
  Description of Artificial Sequence: Synthetic polypeptide

SEQ ID NO: 4608 - protein, 32 aa, Artificial Sequence; identical to SEQ ID NO: 1499
  Description of Artificial Sequence: Synthetic polypeptide

SEQ ID NO: 4609 - protein, 32 aa, Artificial Sequence; identical to SEQ ID NO: 1501
  Description of Artificial Sequence: Synthetic polypeptide

SEQ ID NO: 4610 - protein, 32 aa, Artificial Sequence; identical to SEQ ID NO: 1501
  Description of Artificial Sequence: Synthetic polypeptide

SEQ ID NO: 4611 - protein, 9 aa, Artificial Sequence
  Description of Artificial Sequence: Synthetic peptide
QQYGSSPLT

SEQ ID NO: 4612 - protein, 9 aa, Artificial Sequence
  Description of Artificial Sequence: Synthetic peptide
QQYANSPLT

SEQ ID NO: 4613 - protein, 9 aa, Artificial Sequence
  Description of Artificial Sequence: Synthetic peptide
QQYYSTPYT

SEQ ID NO: 4614 - protein, 9 aa, Artificial Sequence
  Description of Artificial Sequence: Synthetic peptide
QQYYSYPYT

SEQ ID NO: 4615 - protein, 9 aa, Artificial Sequence
  Description of Artificial Sequence: Synthetic peptide
HQSSSLPYT

SEQ ID NO: 4616 - protein, 9 aa, Artificial Sequence
  Description of Artificial Sequence: Synthetic peptide
HQWSSYPPT

SEQ ID NO: 4617 - protein, 9 aa, Artificial Sequence
  Description of Artificial Sequence: Synthetic peptide
LQDYNYPYT

SEQ ID NO: 4618 - protein, 9 aa, Artificial Sequence
  Description of Artificial Sequence: Synthetic peptide
QHHYGTPLT

SEQ ID NO: 4619 - protein, 9 aa, Artificial Sequence
  Description of Artificial Sequence: Synthetic peptide
MQALQTPIT

SEQ ID NO: 4620 - protein, 9 aa, Artificial Sequence
  Description of Artificial Sequence: Synthetic peptide
MQALQTPPT

SEQ ID NO: 4621 - protein, 9 aa, Artificial Sequence
  Description of Artificial Sequence: Synthetic peptide
MQALQTPFT

SEQ ID NO: 4622 - protein, 9 aa, Artificial Sequence
  Description of Artificial Sequence: Synthetic peptide
MQALQTPPT

SEQ ID NO: 4623 - protein, 9 aa, Artificial Sequence
  Description of Artificial Sequence: Synthetic peptide
QQYGSSPYT

SEQ ID NO: 4624 - protein, 9 aa, Artificial Sequence
  Description of Artificial Sequence: Synthetic peptide
QQYGSSPLT

SEQ ID NO: 4625 - protein, 10 aa, Artificial Sequence
  Description of Artificial Sequence: Synthetic peptide
LLYYGGAQWV

SEQ ID NO: 4626 - protein, 9 aa, Artificial Sequence
  Description of Artificial Sequence: Synthetic peptide
VLWYSNRWV

SEQ ID NO: 4627 - protein, 9 aa, Artificial Sequence
  Description of Artificial Sequence: Synthetic peptide
VLWYSNRWV

SEQ ID NO: 4628 - protein, 9 aa, Artificial Sequence
  Description of Artificial Sequence: Synthetic peptide
VLWYSNRWV

SEQ ID NO: 4629 - protein, 9 aa, Artificial Sequence
  Description of Artificial Sequence: Synthetic peptide
VLWYSNRWV

SEQ ID NO: 4630 - protein, 9 aa, Artificial Sequence
  Description of Artificial Sequence: Synthetic peptide
VLWYSNRWV

SEQ ID NO: 4631 - protein, 9 aa, Artificial Sequence
  Description of Artificial Sequence: Synthetic peptide
VLWYSNRWV

SEQ ID NO: 4632 - protein, 9 aa, Artificial Sequence
  Description of Artificial Sequence: Synthetic peptide
VLWYSNRWV

SEQ ID NO: 4633 - protein, 9 aa, Artificial Sequence
  Description of Artificial Sequence: Synthetic peptide
VLWYSNRWV

SEQ ID NO: 4634 - protein, 10 aa, Artificial Sequence
  Description of Artificial Sequence: Synthetic peptide
LLSYSGARWV

SEQ ID NO: 4635 - protein, 11 aa, Artificial Sequence
  Description of Artificial Sequence: Synthetic peptide
FLSYSGARNWV

SEQ ID NO: 4636 - protein, 15 aa, Artificial Sequence
  Description of Artificial Sequence: Synthetic peptide
DIVVVVAATAEYFQH

SEQ ID NO: 4637 - protein, 11 aa, Artificial Sequence
  Description of Artificial Sequence: Synthetic peptide
DRIAVATYFDN

SEQ ID NO: 4638 - protein, 13 aa, Artificial Sequence
  Description of Artificial Sequence: Synthetic peptide
ITIFGVVIIYFDY

SEQ ID NO: 4639 - protein, 14 aa, Artificial Sequence
  Description of Artificial Sequence: Synthetic peptide
HGNFGNSYISYWAY

SEQ ID NO: 4640 - protein, 14 aa, Artificial Sequence
  Description of Artificial Sequence: Synthetic peptide
HGNFGNSYISYWAY

SEQ ID NO: 4641 - protein, 14 aa, Artificial Sequence
  Description of Artificial Sequence: Synthetic peptide
HGNFGNSYISYWAY

SEQ ID NO: 4642 - protein, 14 aa, Artificial Sequence
  Description of Artificial Sequence: Synthetic peptide
HGNFGNSYISYWAY

SEQ ID NO: 4643 - protein, 14 aa, Artificial Sequence
  Description of Artificial Sequence: Synthetic peptide
HGNFGNSYISYWAY

SEQ ID NO: 4644 - protein, 14 aa, Artificial Sequence
  Description of Artificial Sequence: Synthetic peptide
HGNFGNSYISYWAY

SEQ ID NO: 4645 - protein, 14 aa, Artificial Sequence
  Description of Artificial Sequence: Synthetic peptide
HGNFGNSYISYWAY

SEQ ID NO: 4646 - protein, 14 aa, Artificial Sequence
  Description of Artificial Sequence: Synthetic peptide
HGNFGNSYISYWAY

SEQ ID NO: 4647 - protein, 21 aa, Artificial Sequence
  Description of Artificial Sequence: Synthetic peptide
YYDYVWGSYRYTYYYYYGMDV

SEQ ID NO: 4648 - protein, 18 aa, Artificial Sequence
  Description of Artificial Sequence: Synthetic peptide
PYDYVWGSYRNYYYGMDV

SEQ ID NO: 4649 - protein, 13 aa, Artificial Sequence
  Description of Artificial Sequence: Synthetic peptide
DIVVVVAATYFDY

SEQ ID NO: 4650 - protein, 10 aa, Artificial Sequence
  Description of Artificial Sequence: Synthetic peptide
DGVFYAPLAY

SEQ ID NO: 4651 - protein, 10 aa, Artificial Sequence
  Description of Artificial Sequence: Synthetic peptide
GYSYGYYFDY

SEQ ID NO: 4652 - protein, 13 aa, Artificial Sequence
  Description of Artificial Sequence: Synthetic peptide
GNYFGSSEAYFDY

SEQ ID NO: 4653 - protein, 10 aa, Artificial Sequence
  Description of Artificial Sequence: Synthetic peptide
VQLERDAFDI

SEQ ID NO: 4654 - protein, 11 aa, Artificial Sequence
  Description of Artificial Sequence: Synthetic peptide
RQLNHVFAMDY

SEQ ID NO: 4655 - protein, 15 aa, Artificial Sequence
  Description of Artificial Sequence: Synthetic peptide
GYSYGYYYYYYGMDV

SEQ ID NO: 4656 - protein, 14 aa, Artificial Sequence
  Description of Artificial Sequence: Synthetic peptide
GGGYSNGYDYGMDV

SEQ ID NO: 4657 - protein, 16 aa, Artificial Sequence
  Description of Artificial Sequence: Synthetic peptide
GYSGYDYYYYYYGMDV

SEQ ID NO: 4658 - protein, 14 aa, Artificial Sequence
  Description of Artificial Sequence: Synthetic peptide
GGGYSYGYDYGMDV

SEQ ID NO: 4659 - protein, 14 aa, Artificial Sequence
  Description of Artificial Sequence: Synthetic peptide
VQLERYYYYYGMDV

SEQ ID NO: 4660 - protein, 12 aa, Artificial Sequence
  Description of Artificial Sequence: Synthetic peptide
EQWPNYYYGMDV

SEQ ID NO: 4661 - protein, 10 aa, Artificial Sequence
  Description of Artificial Sequence: Synthetic peptide
FGGGTKVEIK

SEQ ID NO: 4662 - protein, 10 aa, Artificial Sequence
  Description of Artificial Sequence: Synthetic peptide
FGCGTKVEIK

SEQ ID NO: 4663 - protein, 10 aa, Artificial Sequence
  Description of Artificial Sequence: Synthetic peptide
FGQGTKLEIK

SEQ ID NO: 4664 - protein, 10 aa, Artificial Sequence
  Description of Artificial Sequence: Synthetic peptide
FGCGTKLELK

SEQ ID NO: 4665 - protein, 10 aa, Artificial Sequence
  Description of Artificial Sequence: Synthetic peptide
FGQGTKLEIK

SEQ ID NO: 4666 - protein, 10 aa, Artificial Sequence
  Description of Artificial Sequence: Synthetic peptide
FGCGTKLEIK

SEQ ID NO: 4667 - protein, 10 aa, Artificial Sequence
  Description of Artificial Sequence: Synthetic peptide
FGQGTKLEIK

SEQ ID NO: 4668 - protein, 10 aa, Artificial Sequence
  Description of Artificial Sequence: Synthetic peptide
FGCGTKLELK

SEQ ID NO: 4669 - protein, 10 aa, Artificial Sequence
  Description of Artificial Sequence: Synthetic peptide
FGQGTRLEIK

SEQ ID NO: 4670 - protein, 10 aa, Artificial Sequence
  Description of Artificial Sequence: Synthetic peptide
FGCGTRLEIK

SEQ ID NO: 4671 - protein, 10 aa, Artificial Sequence
  Description of Artificial Sequence: Synthetic peptide
FGPGTKVDIK

SEQ ID NO: 4672 - protein, 10 aa, Artificial Sequence
  Description of Artificial Sequence: Synthetic peptide
FGCGTKVDIK

SEQ ID NO: 4673 - protein, 10 aa, Artificial Sequence
  Description of Artificial Sequence: Synthetic peptide
FGQGTKLEIK

SEQ ID NO: 4674 - protein, 10 aa, Artificial Sequence
  Description of Artificial Sequence: Synthetic peptide
FGCGTKLEIK

SEQ ID NO: 4675 - protein, 10 aa, Artificial Sequence
  Description of Artificial Sequence: Synthetic peptide
FGGGTKLTVL

SEQ ID NO: 4676 - protein, 10 aa, Artificial Sequence
  Description of Artificial Sequence: Synthetic peptide
FGGGTKLTVL

SEQ ID NO: 4677 - protein, 10 aa, Artificial Sequence
  Description of Artificial Sequence: Synthetic peptide
FGGGTKLTVL

SEQ ID NO: 4678 - protein, 10 aa, Artificial Sequence
  Description of Artificial Sequence: Synthetic peptide
FGGGTKLTVL

SEQ ID NO: 4679 - protein, 10 aa, Artificial Sequence
  Description of Artificial Sequence: Synthetic peptide
FGGGTKLTVL

SEQ ID NO: 4680 - protein, 10 aa, Artificial Sequence
  Description of Artificial Sequence: Synthetic peptide
FGGGTKLTVL

SEQ ID NO: 4681 - protein, 10 aa, Artificial Sequence
  Description of Artificial Sequence: Synthetic peptide
FGGGTKLTVL

SEQ ID NO: 4682 - protein, 10 aa, Artificial Sequence
  Description of Artificial Sequence: Synthetic peptide
FGGGTKLTVL

SEQ ID NO: 4683 - protein, 10 aa, Artificial Sequence
  Description of Artificial Sequence: Synthetic peptide
FGGGTKLTVL

SEQ ID NO: 4684 - protein, 10 aa, Artificial Sequence
  Description of Artificial Sequence: Synthetic peptide
FGGGTKLTVL

SEQ ID NO: 4685 - protein, 10 aa, Artificial Sequence
  Description of Artificial Sequence: Synthetic peptide
FGCGTKLTVL

SEQ ID NO: 4686 - protein, 11 aa, Artificial Sequence
  Description of Artificial Sequence: Synthetic peptide
WGQGTLVTVSS

SEQ ID NO: 4687 - protein, 11 aa, Artificial Sequence
  Description of Artificial Sequence: Synthetic peptide
WGQGTLVTVSS

SEQ ID NO: 4688 - protein, 11 aa, Artificial Sequence
  Description of Artificial Sequence: Synthetic peptide
WGQGTLVTVSS

SEQ ID NO: 4689 - protein, 11 aa, Artificial Sequence
  Description of Artificial Sequence: Synthetic peptide
WGQGTLVTVSS

SEQ ID NO: 4690 - protein, 11 aa, Artificial Sequence
  Description of Artificial Sequence: Synthetic peptide
WGQGTLVTVSS

SEQ ID NO: 4691 - protein, 11 aa, Artificial Sequence
  Description of Artificial Sequence: Synthetic peptide
WGQGTLVTVSS

SEQ ID NO: 4692 - protein, 11 aa, Artificial Sequence
  Description of Artificial Sequence: Synthetic peptide
WGQGTLVTVSS

SEQ ID NO: 4693 - protein, 11 aa, Artificial Sequence
  Description of Artificial Sequence: Synthetic peptide
WGQGTLVTVSS

SEQ ID NO: 4694 - protein, 11 aa, Artificial Sequence
  Description of Artificial Sequence: Synthetic peptide
WGQGTLVTVSS

SEQ ID NO: 4695 - protein, 11 aa, Artificial Sequence
  Description of Artificial Sequence: Synthetic peptide
WGQGTLVTVSS

SEQ ID NO: 4696 - protein, 11 aa, Artificial Sequence
  Description of Artificial Sequence: Synthetic peptide
WGQGTLVTVSS

SEQ ID NO: 4697 - protein, 11 aa, Artificial Sequence
  Description of Artificial Sequence: Synthetic peptide
WGQGTTVTVSS

SEQ ID NO: 4698 - protein, 11 aa, Artificial Sequence
  Description of Artificial Sequence: Synthetic peptide
WGQGTTVTVSS

SEQ ID NO: 4699 - protein, 11 aa, Artificial Sequence
  Description of Artificial Sequence: Synthetic peptide
WGQGTLVTVSS

SEQ ID NO: 4700 - protein, 11 aa, Artificial Sequence
  Description of Artificial Sequence: Synthetic peptide
WGQGTLVTVSS

SEQ ID NO: 4701 - protein, 11 aa, Artificial Sequence
  Description of Artificial Sequence: Synthetic peptide
WGQGTLVTVSS

SEQ ID NO: 4702 - protein, 11 aa, Artificial Sequence
  Description of Artificial Sequence: Synthetic peptide
WGQGTRVTVSS

SEQ ID NO: 4703 - protein, 11 aa, Artificial Sequence
  Description of Artificial Sequence: Synthetic peptide
WGQGTMVTVSS

SEQ ID NO: 4704 - protein, 11 aa, Artificial Sequence
  Description of Artificial Sequence: Synthetic peptide
WGQGTSVTVSS

SEQ ID NO: 4705 - protein, 11 aa, Artificial Sequence
  Description of Artificial Sequence: Synthetic peptide
WGQGTTVTVSS

SEQ ID NO: 4706 - protein, 11 aa, Artificial Sequence
  Description of Artificial Sequence: Synthetic peptide
WGQGTTVTVSS

SEQ ID NO: 4707 - protein, 11 aa, Artificial Sequence
  Description of Artificial Sequence: Synthetic peptide
WGQGTTVTVSS

SEQ ID NO: 4708 - protein, 11 aa, Artificial Sequence
  Description of Artificial Sequence: Synthetic peptide
WGQGTTVTVSS

SEQ ID NO: 4709 - protein, 11 aa, Artificial Sequence
  Description of Artificial Sequence: Synthetic peptide
WGQGTTVTVSS

SEQ ID NO: 4710 - protein, 11 aa, Artificial Sequence
  Description of Artificial Sequence: Synthetic peptide
WGQGTTVTVSS

SEQ ID NO: 4711 - protein, 1008 aa, Artificial Sequence; identical to SEQ ID NO: 3875
  Description of Artificial Sequence: Synthetic polypeptide

SEQ ID NO: 4712 - protein, 1008 aa, Artificial Sequence
  Description of Artificial Sequence: Synthetic polypeptide
MDMRVPAQLLGLLLLWLRGARCEVQLVESGGGLVKPGGSLRLSCAASGFTFSTYSMNWVRQAPGKGLEWVSSISSSSSYIYYADSVKGRFTISRDNAKNSLYLQMNSLRDEDTAVYYCARDRIAVATYFDNWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYANSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4713 - protein, 1008 aa, Artificial Sequence
  Description of Artificial Sequence: Synthetic polypeptide
MDMRVPAQLLGLLLLWLRGARCEVQLLESGGGLVQPGGSLRLSCAASGFTFSSFAMSWVRQAPGKCLEWVSAISGSGGSTYYADSVKGRFTISRDNSKNTLYLQMNSLRAEDTAEYYCAKMVTPDYYYDMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDFATYYCQQSYSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4714 - protein, 1008 aa, Artificial Sequence
  Description of Artificial Sequence: Synthetic polypeptide
MDMRVPAQLLGLLLLWLRGARCEVQLLESGGGLVQPGGSLRLSCAASGFTFSSFAMSWVRQAPGKGLEWVSAISGSGGSTYYADSVKGRFTISRDNSKNTLYLQMNSLRAEDTAEYYCAKMVTPDYYYDMDVWGQGTTVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDFATYYCQQSYSTPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4715 - protein, 1013 aa, Artificial Sequence; identical to SEQ ID NO: 3877
  Description of Artificial Sequence: Synthetic polypeptide

SEQ ID NO: 4716 - protein, 1013 aa, Artificial Sequence
  Description of Artificial Sequence: Synthetic polypeptide
MDMRVPAQLLGLLLLWLRGARCEVQLLEQSGPELVKPGASVKISCKASGYAFSKSWMNWVKQRPGKGLEWIGRIYPGDGDTNYNGKFKGKAALTADKSSNTANMQLNSLTSEDSAVYFCARDGVFYAPLAYWGQGTLVTVSSGGGGSGGGGSGGGGSELVMTQSPSSLAVSVGEKITMSCKSSQSLLYSSNQKNYLAWYQQKPGQSPKLLIYWASTRESGVPDRFTGSGSGTDFTLTISSVKAEDLAVYYCQQYYSYPYTFGGGTKLELKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4717 - protein, 1009 aa, Artificial Sequence; identical to SEQ ID NO: 3878
  Description of Artificial Sequence: Synthetic polypeptide

SEQ ID NO: 4718 - protein, 1009 aa, Artificial Sequence
  Description of Artificial Sequence: Synthetic polypeptide
MDMRVPAQLLGLLLLWLRGARCEVQLLEQSGPELVKPGASVKISCKASDYTFSKSWMNWVKQRPGEGLEWIGRVWPGDGDTTYNEKFKGKATLTADKSSRTAYMQLSSLTSEDSAVYFCARGNYFGSSEAYFDYWGQGTRVTVSSGGGGSGGGGSGGGGSELVLTQSPAIMSASPGQKVTITCSASSNVNYIHWYQQKLGSSPKLWIYDTSKLAPGVPARFSGSGSGTSYSLTISSMEAEDAASYFCHQWSSYPPTFGSGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4719 - protein, 1008 aa, Artificial Sequence; identical to SEQ ID NO: 3879
  Description of Artificial Sequence: Synthetic polypeptide

SEQ ID NO: 4720 - protein, 1008 aa, Artificial Sequence
  Description of Artificial Sequence: Synthetic polypeptide
MDMRVPAQLLGLLLLWLRGARCEVQLLEQSGPELVKPGASVKISCKASGYAFSSSWMNWVKQRPGKGLEWIGRIYPGDGDTNYNGKFKDKATLTADKSSNTAYMQLSSLTSEDSAVYFCARRQLNHVFAMDYWGQGTSVTVSSGGGGSGGGGSGGGGSELQMTQSPASLSASVGETVTITCRASGNIHNYLAWYQQKQGKSPQLLVYNAKTLAGGVPSRFSGSGSGTQFSLKINSLQPEDFGSYYCQHHYGTPLTFGAGTKLELKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4721 - protein, 1015 aa, Artificial Sequence; identical to SEQ ID NO: 3880
  Description of Artificial Sequence: Synthetic polypeptide

SEQ ID NO: 4722 - protein, 1015 aa, Artificial Sequence
  Description of Artificial Sequence: Synthetic polypeptide
MDMRVPAQLLGLLLLWLRGARCQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGGYSNGYDYGMDVWGQGTTVTVSSGGGGSGGGGSGGGGSDIVMTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPPTFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4723 - protein, 1009 aa, Artificial Sequence; identical to SEQ ID NO: 3882
  Description of Artificial Sequence: Synthetic polypeptide

SEQ ID NO: 4724 - protein, 1009 aa, Artificial Sequence
  Description of Artificial Sequence: Synthetic polypeptide
MDMRVPAQLLGLLLLWLRGARCQVQLVESGGGVVQPGRSLRLSCAASGFTFRSYRMHWVRQAPGKGLEWVAVISYDGGNKYYADSVKGRFTISRDNSKNTLYLQMNSLRAEDTAVYYCAREQWPNYYYGMDVWGQGTTVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4725 - protein, 1020 aa, Artificial Sequence
  Description of Artificial Sequence: Synthetic polypeptide
MDMRVPAQLLGLLLLWLRGARCQVQLQQSGPGLVKPSQTLSLTCAISGDSVSSNSAAWNWIRQSPSRCLEWLGRTYYRSKWYNDYAVSVKSRITINPDTSKNQFSLQLNSVTPEDTAVYYCVREILWFGKLNYYYGMDVWGQGTTVTVSSGGGGSGGGGSGGGGSDIVLTQSPLSLPVTPGDPASISCRSSQSLLHSNGYNYLDWYLQKPGQSPQLLIYLGSNRASGVPDRFSGSGSGTDFTLKISRVEAEDVGVYYCMQALQTPLTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4726 - protein, 1020 aa, Artificial Sequence
  Description of Artificial Sequence: Synthetic polypeptide
MDMRVPAQLLGLLLLWLRGARCQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCVREILWFGKLNYYYGMDVWGQGTTVTVSSGGGGSGGGGSGGGGSDIVLTQSPLSLPVTPGDPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4727 - protein, 1014 aa, Artificial Sequence
  Description of Artificial Sequence: Synthetic polypeptide
MDMRVPAQLLGLLLLWLRGARCQVQLQQWGAGLLKPSETLSLTCAVYGGSFSGYYWNWIRQPPGKCLEWIGEINHRGSTNYNPSLKSRVTISVDASKNQFSLKLSSVTAADTAVYYCARGGGYSDGYDYGMDVWGQGTTVTVSSGGGGSGGGGSGGGGSDIVLTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPFTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4728 - protein, 1014 aa, Artificial Sequence
  Description of Artificial Sequence: Synthetic polypeptide
MDMRVPAQLLGLLLLWLRGARCQVQLQQWGAGLLKPSETLSLTCAVYGGSFSGYYWNWIRQPPGKGLEWIGEINHRGSTNYNPSLKSRVTISVDASKNQFSLKLSSVTAADTAVYYCARGGGYSDGYDYGMDVWGQGTTVTVSSGGGGSGGGGSGGGGSDIVLTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPFTFGPGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4729 - protein, 1008 aa, Artificial Sequence
  Description of Artificial Sequence: Synthetic polypeptide
MDMRVPAQLLGLLLLWLRGARCEVQLLESGGGLVQPGGSLRLSCAASGFTFSSFAMSWVRQAPGKCLEWVSAISGSGGSTYYADSVKGRFTISRDNSKNTLYLQMNSLRAEDTAEYYCAKMVTPDYYYDMDVWGQGTTVTVSSGGGGSGGGGSGGGGSDIQMTQSPSSVSASVGDRVTITCRASQSISSYLNWYQQKPGKAPKSLIYAASSLQSGVPSRFSGSGSGTDFTLTISSLQPEDFATYYCQQSYRTPPTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4730 - protein, 1008 aa, Artificial Sequence
  Description of Artificial Sequence: Synthetic polypeptide
MDMRVPAQLLGLLLLWLRGARCEVQLLESGGGLVQPGGSLRLSCAASGFTFSSFAMSWVRQAPGKGLEWVSAISGSGGSTYYADSVKGRFTISRDNSKNTLYLQMNSLRAEDTAEYYCAKMVTPDYYYDMDVWGQGTTVTVSSGGGGSGGGGSGGGGSDIQMTQSPSSVSASVGDRVTITCRASQSISSYLNWYQQKPGKAPKSLIYAASSLQSGVPSRFSGSGSGTDFTLTISSLQPEDFATYYCQQSYRTPPTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4731 - protein, 1005 aa, Artificial Sequence
  Description of Artificial Sequence: Synthetic polypeptide
MDMRVPAQLLGLLLLWLRGARCQVQLVQSGAEVKKPGASVKVSCKASGYSFTGYYMHWVRQAPGQCLEWMGRINPNSGDTHYAQKFQGRVTMTRDTSISTAYMELSRLRSDDTAVYYCARGLGISFFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPWTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4732 - protein, 1005 aa, Artificial Sequence
  Description of Artificial Sequence: Synthetic polypeptide
MDMRVPAQLLGLLLLWLRGARCQVQLVQSGAEVKKPGASVKVSCKASGYSFTGYYMHWVRQAPGQGLEWMGRINPNSGDTHYAQKFQGRVTMTRDTSISTAYMELSRLRSDDTAVYYCARGLGISFFDYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4733 - protein, 1018 aa, Artificial Sequence
  Description of Artificial Sequence: Synthetic polypeptide
MDMRVPAQLLGLLLLWLRGARCQVQLQESGPGLVKPSQTLSLTCTVSGDSISRDPYYWSWIRQHPGKCLEWIGYIYYSGSTYYNPSLKSRVTISVDTSKNQFSLKLSSVTAADTAVYYCARDKLWFGKLNYYYGMDVWGQGTTVTVSSGGGGSGGGGSGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4734 - protein, 1018 aa, Artificial Sequence
  Description of Artificial Sequence: Synthetic polypeptide
MDMRVPAQLLGLLLLWLRGARCQVQLQESGPGLVKPSQTLSLTCTVSGDSISRDPYYWSWIRQHPGKGLEWIGYIYYSGSTYYNPSLKSRVTISVDTSKNQFSLKLSSVTAADTAVYYCARDKLWFGKLNYYYGMDVWGQGTTVTVSSGGGGSGGGGSGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4735 - protein, 12 aa, Artificial Sequence
  Description of Artificial Sequence: Synthetic peptide
RASQSVSSSYLA

SEQ ID NO: 4736 - protein, 12 aa, Artificial Sequence
  Description of Artificial Sequence: Synthetic peptide
RASQSVSSSYLA

SEQ ID NO: 4737 - protein, 11 aa, Artificial Sequence
  Description of Artificial Sequence: Synthetic peptide
RASQGISNYLA

SEQ ID NO: 4738 - protein, 11 aa, Artificial Sequence
  Description of Artificial Sequence: Synthetic peptide
RASQGISNYLA

SEQ ID NO: 4739 - protein, 17 aa, Artificial Sequence
  Description of Artificial Sequence: Synthetic peptide
KSSQSLLYSSNQKNYLA

SEQ ID NO: 4740 - protein, 17 aa, Artificial Sequence
  Description of Artificial Sequence: Synthetic peptide
KSSQSLLYSSNQKNYLA

SEQ ID NO: 4741 - protein, 10 aa, Artificial Sequence
  Description of Artificial Sequence: Synthetic peptide
SASSNVNYIH

SEQ ID NO: 4742 - protein, 10 aa, Artificial Sequence
  Description of Artificial Sequence: Synthetic peptide
SASSNVNYIH

SEQ ID NO: 4743 - protein, 11 aa, Artificial Sequence
  Description of Artificial Sequence: Synthetic peptide
RASGNIHNYLA

SEQ ID NO: 4744 - protein, 11 aa, Artificial Sequence
  Description of Artificial Sequence: Synthetic peptide
RASGNIHNYLA

SEQ ID NO: 4745 - protein, 16 aa, Artificial Sequence
  Description of Artificial Sequence: Synthetic peptide
RSSQSLLYSNGYNYVD

SEQ ID NO: 4746 - protein, 16 aa, Artificial Sequence
  Description of Artificial Sequence: Synthetic peptide
RSSQSLLYSNGYNYVD

SEQ ID NO: 4747 - protein, 12 aa, Artificial Sequence
  Description of Artificial Sequence: Synthetic peptide
RASQSVSSSYLA

SEQ ID NO: 4748 - protein, 12 aa, Artificial Sequence
  Description of Artificial Sequence: Synthetic peptide
RASQSVSSSYLA

SEQ ID NO: 4749 - protein, 16 aa, Artificial Sequence
  Description of Artificial Sequence: Synthetic peptide
RSSQSLLHSNGYNYLD

SEQ ID NO: 4750 - protein, 16 aa, Artificial Sequence
  Description of Artificial Sequence: Synthetic peptide
RSSQSLLHSNGYNYLD

SEQ ID NO: 4751 - protein, 16 aa, Artificial Sequence
  Description of Artificial Sequence: Synthetic peptide
RSSQSLLYSNGYNYVD

SEQ ID NO: 4752 - protein, 16 aa, Artificial Sequence
  Description of Artificial Sequence: Synthetic peptide
RSSQSLLYSNGYNYVD

SEQ ID NO: 4753 - protein, 11 aa, Artificial Sequence
  Description of Artificial Sequence: Synthetic peptide
RASQSISSYLN

SEQ ID NO: 4754 - protein, 11 aa, Artificial Sequence
  Description of Artificial Sequence: Synthetic peptide
RASQSISSYLN

SEQ ID NO: 4755 - protein, 11 aa, Artificial Sequence
  Description of Artificial Sequence: Synthetic peptide
RASQGISNYLA

SEQ ID NO: 4756 - protein, 11 aa, Artificial Sequence
  Description of Artificial Sequence: Synthetic peptide
RASQGISNYLA

SEQ ID NO: 4757 - protein, 16 aa, Artificial Sequence
  Description of Artificial Sequence: Synthetic peptide
RSSQSLLHSNGYNYLD

SEQ ID NO: 4758 - protein, 16 aa, Artificial Sequence
  Description of Artificial Sequence: Synthetic peptide
RSSQSLLHSNGYNYLD

SEQ ID NO: 4759 - protein, 5 aa, Artificial Sequence
  Description of Artificial Sequence: Synthetic peptide
TYSMN

SEQ ID NO: 4760 - protein, 5 aa, Artificial Sequence
  Description of Artificial Sequence: Synthetic peptide
TYSMN

SEQ ID NO: 4761 - protein, 5 aa, Artificial Sequence
  Description of Artificial Sequence: Synthetic peptide
SFAMS

SEQ ID NO: 4762 - protein, 5 aa, Artificial Sequence
  Description of Artificial Sequence: Synthetic peptide
SFAMS

SEQ ID NO: 4763 - protein, 5 aa, Artificial Sequence
  Description of Artificial Sequence: Synthetic peptide
KSWMN

SEQ ID NO: 4764 - protein, 5 aa, Artificial Sequence
  Description of Artificial Sequence: Synthetic peptide
KSWMN

SEQ ID NO: 4765 - protein, 5 aa, Artificial Sequence
  Description of Artificial Sequence: Synthetic peptide
KSWMN

SEQ ID NO: 4766 - protein, 5 aa, Artificial Sequence
  Description of Artificial Sequence: Synthetic peptide
KSWMN

SEQ ID NO: 4767 - protein, 5 aa, Artificial Sequence
  Description of Artificial Sequence: Synthetic peptide
SSWMN

SEQ ID NO: 4768 - protein, 5 aa, Artificial Sequence
  Description of Artificial Sequence: Synthetic peptide
SSWMN

SEQ ID NO: 4769 - protein, 5 aa, Artificial Sequence
  Description of Artificial Sequence: Synthetic peptide
SYDIN

SEQ ID NO: 4770 - protein, 5 aa, Artificial Sequence
  Description of Artificial Sequence: Synthetic peptide
SYDIN

SEQ ID NO: 4771 - protein, 5 aa, Artificial Sequence
  Description of Artificial Sequence: Synthetic peptide
SYRMH

SEQ ID NO: 4772 - protein, 5 aa, Artificial Sequence
  Description of Artificial Sequence: Synthetic peptide
SYRMH

SEQ ID NO: 4773 - protein, 7 aa, Artificial Sequence
  Description of Artificial Sequence: Synthetic peptide
SNSAAWN

SEQ ID NO: 4774 - protein, 7 aa, Artificial Sequence
  Description of Artificial Sequence: Synthetic peptide
SNSAAWN

SEQ ID NO: 4775 - protein, 5 aa, Artificial Sequence
  Description of Artificial Sequence: Synthetic peptide
GYYWN

SEQ ID NO: 4776 - protein, 5 aa, Artificial Sequence
  Description of Artificial Sequence: Synthetic peptide
GYYWN

SEQ ID NO: 4777 - protein, 5 aa, Artificial Sequence
  Description of Artificial Sequence: Synthetic peptide
SFAMS

SEQ ID NO: 4778 - protein, 5 aa, Artificial Sequence
  Description of Artificial Sequence: Synthetic peptide
SFAMS

SEQ ID NO: 4779 - protein, 5 aa, Artificial Sequence
  Description of Artificial Sequence: Synthetic peptide
GYYMH

SEQ ID NO: 4780 - protein, 5 aa, Artificial Sequence
  Description of Artificial Sequence: Synthetic peptide
GYYMH

SEQ ID NO: 4781 - protein, 7 aa, Artificial Sequence
  Description of Artificial Sequence: Synthetic peptide
RDPYYWS

SEQ ID NO: 4782 - protein, 7 aa, Artificial Sequence
  Description of Artificial Sequence: Synthetic peptide
RDPYYWS

SEQ ID NO: 4783 - protein, 14 aa, Artificial Sequence
  Description of Artificial Sequence: Synthetic peptide
GSSTGAVTSGNYPN

SEQ ID NO: 4784 - protein, 14 aa, Artificial Sequence
  Description of Artificial Sequence: Synthetic peptide
GSSTGAVTSGNYPN

SEQ ID NO: 4785 - protein, 14 aa, Artificial Sequence
  Description of Artificial Sequence: Synthetic peptide
GSSTGAVTSGNYPN

SEQ ID NO: 4786 - protein, 14 aa, Artificial Sequence
  Description of Artificial Sequence: Synthetic peptide
GSSTGAVTSGNYPN

SEQ ID NO: 4787 - protein, 14 aa, Artificial Sequence
  Description of Artificial Sequence: Synthetic peptide
GSSTGAVTSGNYPN

SEQ ID NO: 4788 - protein, 14 aa, Artificial Sequence
  Description of Artificial Sequence: Synthetic peptide
GSSTGAVTSGNYPN

SEQ ID NO: 4789 - protein, 14 aa, Artificial Sequence
  Description of Artificial Sequence: Synthetic peptide
GSSTGAVTSGNYPN

SEQ ID NO: 4790 - protein, 14 aa, Artificial Sequence
  Description of Artificial Sequence: Synthetic peptide
GSSTGAVTSGNYPN

SEQ ID NO: 4791 - protein, 14 aa, Artificial Sequence
  Description of Artificial Sequence: Synthetic peptide
GSSTGAVTSGNYPN

SEQ ID NO: 4792 - protein, 14 aa, Artificial Sequence
  Description of Artificial Sequence: Synthetic peptide
GSSTGAVTSGNYPN

SEQ ID NO: 4793 - protein, 14 aa, Artificial Sequence
  Description of Artificial Sequence: Synthetic peptide
GSSTGAVTSGNYPN

SEQ ID NO: 4794 - protein, 14 aa, Artificial Sequence
  Description of Artificial Sequence: Synthetic peptide
GSSTGAVTSGNYPN

SEQ ID NO: 4795 - protein, 14 aa, Artificial Sequence
  Description of Artificial Sequence: Synthetic peptide
GSSTGAVTSGNYPN

SEQ ID NO: 4796 - protein, 14 aa, Artificial Sequence
  Description of Artificial Sequence: Synthetic peptide
GSSTGAVTSGNYPN

SEQ ID NO: 4797 - protein, 14 aa, Artificial Sequence
  Description of Artificial Sequence: Synthetic peptide
GSSTGAVTSGNYPN

SEQ ID NO: 4798 - protein, 14 aa, Artificial Sequence
  Description of Artificial Sequence: Synthetic peptide
GSSTGAVTSGNYPN

SEQ ID NO: 4799 - protein, 14 aa, Artificial Sequence
  Description of Artificial Sequence: Synthetic peptide
GSSTGAVTSGNYPN

SEQ ID NO: 4800 - protein, 14 aa, Artificial Sequence
  Description of Artificial Sequence: Synthetic peptide
GSSTGAVTSGNYPN

SEQ ID NO: 4801 - protein, 14 aa, Artificial Sequence
  Description of Artificial Sequence: Synthetic peptide
GSSTGAVTSGNYPN

SEQ ID NO: 4802 - protein, 14 aa, Artificial Sequence
  Description of Artificial Sequence: Synthetic peptide
GSSTGAVTSGNYPN

SEQ ID NO: 4803 - protein, 14 aa, Artificial Sequence
  Description of Artificial Sequence: Synthetic peptide
GSSTGAVTSGNYPN

SEQ ID NO: 4804 - protein, 14 aa, Artificial Sequence
  Description of Artificial Sequence: Synthetic peptide
GSSTGAVTSGNYPN

SEQ ID NO: 4805 - protein, 14 aa, Artificial Sequence
  Description of Artificial Sequence: Synthetic peptide
GSSTGAVTSGNYPN

SEQ ID NO: 4806 - protein, 14 aa, Artificial Sequence
  Description of Artificial Sequence: Synthetic peptide
GSSTGAVTSGNYPN

SEQ ID NO: 4807 - protein, 5 aa, Artificial Sequence
  Description of Artificial Sequence: Synthetic peptide
KYAMN

SEQ ID NO: 4808 - protein, 5 aa, Artificial Sequence
  Description of Artificial Sequence: Synthetic peptide
KYAMN

SEQ ID NO: 4809 - protein, 5 aa, Artificial Sequence
  Description of Artificial Sequence: Synthetic peptide
KYAMN

SEQ ID NO: 4810 - protein, 5 aa, Artificial Sequence
  Description of Artificial Sequence: Synthetic peptide
KYAMN

SEQ ID NO: 4811 - protein, 5 aa, Artificial Sequence
  Description of Artificial Sequence: Synthetic peptide
KYAMN

SEQ ID NO: 4812 - protein, 5 aa, Artificial Sequence
  Description of Artificial Sequence: Synthetic peptide
KYAMN

SEQ ID NO: 4813 - protein, 5 aa, Artificial Sequence
  Description of Artificial Sequence: Synthetic peptide
KYAMN

SEQ ID NO: 4814 - protein, 5 aa, Artificial Sequence
  Description of Artificial Sequence: Synthetic peptide
KYAMN

SEQ ID NO: 4815 - protein, 5 aa, Artificial Sequence
  Description of Artificial Sequence: Synthetic peptide
KYAMN

SEQ ID NO: 4816 - protein, 5 aa, Artificial Sequence
  Description of Artificial Sequence: Synthetic peptide
KYAMN

SEQ ID NO: 4817 - protein, 5 aa, Artificial Sequence
  Description of Artificial Sequence: Synthetic peptide
KYAMN

SEQ ID NO: 4818 - protein, 5 aa, Artificial Sequence
  Description of Artificial Sequence: Synthetic peptide
KYAMN

SEQ ID NO: 4819 - protein, 5 aa, Artificial Sequence
  Description of Artificial Sequence: Synthetic peptide
KYAMN

SEQ ID NO: 4820 - protein, 5 aa, Artificial Sequence
  Description of Artificial Sequence: Synthetic peptide
KYAMN

SEQ ID NO: 4821 - protein, 5 aa, Artificial Sequence
  Description of Artificial Sequence: Synthetic peptide
KYAMN

SEQ ID NO: 4822 - protein, 5 aa, Artificial Sequence
  Description of Artificial Sequence: Synthetic peptide
KYAMN

SEQ ID NO: 4823 - protein, 5 aa, Artificial Sequence
  Description of Artificial Sequence: Synthetic peptide
KYAMN

SEQ ID NO: 4824 - protein, 5 aa, Artificial Sequence
  Description of Artificial Sequence: Synthetic peptide
KYAMN

SEQ ID NO: 4825 - protein, 5 aa, Artificial Sequence
  Description of Artificial Sequence: Synthetic peptide
KYAMN

SEQ ID NO: 4826 - protein, 5 aa, Artificial Sequence
  Description of Artificial Sequence: Synthetic peptide
KYAMN

SEQ ID NO: 4827 - protein, 5 aa, Artificial Sequence
  Description of Artificial Sequence: Synthetic peptide
KYAMN

SEQ ID NO: 4828 - protein, 5 aa, Artificial Sequence
  Description of Artificial Sequence: Synthetic peptide
KYAMN

SEQ ID NO: 4829 - protein, 5 aa, Artificial Sequence
  Description of Artificial Sequence: Synthetic peptide
KYAMN

SEQ ID NO: 4830 - protein, 5 aa, Artificial Sequence
  Description of Artificial Sequence: Synthetic peptide
KYAMN

SEQ ID NO: 4831 - protein, 7 aa, Artificial Sequence
  Description of Artificial Sequence: Synthetic peptide
GASSRAT

SEQ ID NO: 4832 - protein, 7 aa, Artificial Sequence
  Description of Artificial Sequence: Synthetic peptide
GASSRAT

SEQ ID NO: 4833 - protein, 7 aa, Artificial Sequence
  Description of Artificial Sequence: Synthetic peptide
AASTLQS

SEQ ID NO: 4834 - protein, 7 aa, Artificial Sequence
  Description of Artificial Sequence: Synthetic peptide
AASTLQS

SEQ ID NO: 4835 - protein, 7 aa, Artificial Sequence
  Description of Artificial Sequence: Synthetic peptide
WASTRES

SEQ ID NO: 4836 - protein, 7 aa, Artificial Sequence
  Description of Artificial Sequence: Synthetic peptide
WASTRES

SEQ ID NO: 4837 - protein, 7 aa, Artificial Sequence
  Description of Artificial Sequence: Synthetic peptide
DTSKLAP

SEQ ID NO: 4838 - protein, 7 aa, Artificial Sequence
  Description of Artificial Sequence: Synthetic peptide
DTSKLAP

SEQ ID NO: 4839 - protein, 7 aa, Artificial Sequence
  Description of Artificial Sequence: Synthetic peptide
NAKTLAG

SEQ ID NO: 4840 - protein, 7 aa, Artificial Sequence
  Description of Artificial Sequence: Synthetic peptide
NAKTLAG

SEQ ID NO: 4841 - protein, 7 aa, Artificial Sequence
  Description of Artificial Sequence: Synthetic peptide
LGSNRAS

SEQ ID NO: 4842 - protein, 7 aa, Artificial Sequence
  Description of Artificial Sequence: Synthetic peptide
LGSNRAS

SEQ ID NO: 4843 - protein, 7 aa, Artificial Sequence
  Description of Artificial Sequence: Synthetic peptide
GASSRAT

SEQ ID NO: 4844 - protein, 7 aa, Artificial Sequence
  Description of Artificial Sequence: Synthetic peptide
GASSRAT

SEQ ID NO: 4845 - protein, 7 aa, Artificial Sequence
  Description of Artificial Sequence: Synthetic peptide
LGSNRAS

SEQ ID NO: 4846 - protein, 7 aa, Artificial Sequence
  Description of Artificial Sequence: Synthetic peptide
LGSNRAS

SEQ ID NO: 4847 - protein, 7 aa, Artificial Sequence
  Description of Artificial Sequence: Synthetic peptide
LGSNRAS

SEQ ID NO: 4848 - protein, 7 aa, Artificial Sequence
  Description of Artificial Sequence: Synthetic peptide
LGSNRAS

SEQ ID NO: 4849 - protein, 7 aa, Artificial Sequence
  Description of Artificial Sequence: Synthetic peptide
AASSLQS

SEQ ID NO: 4850 - protein, 7 aa, Artificial Sequence
  Description of Artificial Sequence: Synthetic peptide
AASSLQS

SEQ ID NO: 4851 - protein, 7 aa, Artificial Sequence
  Description of Artificial Sequence: Synthetic peptide
AASTLQS

SEQ ID NO: 4852 - protein, 7 aa, Artificial Sequence
  Description of Artificial Sequence: Synthetic peptide
AASTLQS

SEQ ID NO: 4853 - protein, 7 aa, Artificial Sequence
  Description of Artificial Sequence: Synthetic peptide
LGSNRAS

SEQ ID NO: 4854 - protein, 7 aa, Artificial Sequence
  Description of Artificial Sequence: Synthetic peptide
LGSNRAS

SEQ ID NO: 4855 - protein, 17 aa, Artificial Sequence
  Description of Artificial Sequence: Synthetic peptide
SISSSSSYIYYADSVKG

SEQ ID NO: 4856 - protein, 17 aa, Artificial Sequence
  Description of Artificial Sequence: Synthetic peptide
SISSSSSYIYYADSVKG

SEQ ID NO: 4857 - protein, 17 aa, Artificial Sequence
  Description of Artificial Sequence: Synthetic peptide
AISGSGGSTYYADSVKG

SEQ ID NO: 4858 - protein, 17 aa, Artificial Sequence
  Description of Artificial Sequence: Synthetic peptide
AISGSGGSTYYADSVKG

SEQ ID NO: 4859 - protein, 17 aa, Artificial Sequence
  Description of Artificial Sequence: Synthetic peptide
RIYPGDGDTNYNGKFKG

SEQ ID NO: 4860 - protein, 17 aa, Artificial Sequence
  Description of Artificial Sequence: Synthetic peptide
RIYPGDGDTNYNGKFKG

SEQ ID NO: 4861 - protein, 17 aa, Artificial Sequence
  Description of Artificial Sequence: Synthetic peptide
RVWPGDGDTTYNEKFKG

SEQ ID NO: 4862 - protein, 17 aa, Artificial Sequence
  Description of Artificial Sequence: Synthetic peptide
RVWPGDGDTTYNEKFKG

SEQ ID NO: 4863 - protein, 17 aa, Artificial Sequence
  Description of Artificial Sequence: Synthetic peptide
RIYPGDGDTNYNGKFKD

SEQ ID NO: 4864 - protein, 17 aa, Artificial Sequence
  Description of Artificial Sequence: Synthetic peptide
RIYPGDGDTNYNGKFKD

SEQ ID NO: 4865 - protein, 17 aa, Artificial Sequence
  Description of Artificial Sequence: Synthetic peptide
WMNPNSGNTGYAQKFQG

SEQ ID NO: 4866 - protein, 17 aa, Artificial Sequence
  Description of Artificial Sequence: Synthetic peptide
WMNPNSGNTGYAQKFQG

SEQ ID NO: 4867 - protein, 17 aa, Artificial Sequence
  Description of Artificial Sequence: Synthetic peptide
VISYDGGNKYYADSVKG

SEQ ID NO: 4868 - protein, 17 aa, Artificial Sequence
  Description of Artificial Sequence: Synthetic peptide
VISYDGGNKYYADSVKG

SEQ ID NO: 4869 - protein, 18 aa, Artificial Sequence
  Description of Artificial Sequence: Synthetic peptide
RTYYRSKWYNDYAVSVKS

SEQ ID NO: 4870 - protein, 18 aa, Artificial Sequence
  Description of Artificial Sequence: Synthetic peptide
RTYYRSKWYNDYAVSVKS

SEQ ID NO: 4871 - protein, 16 aa, Artificial Sequence
  Description of Artificial Sequence: Synthetic peptide
EINHRGSTNYNPSLKS

SEQ ID NO: 4872 - protein, 16 aa, Artificial Sequence
  Description of Artificial Sequence: Synthetic peptide
EINHRGSTNYNPSLKS

SEQ ID NO: 4873 - protein, 17 aa, Artificial Sequence
  Description of Artificial Sequence: Synthetic peptide
AISGSGGSTYYADSVKG

SEQ ID NO: 4874 - protein, 17 aa, Artificial Sequence
  Description of Artificial Sequence: Synthetic peptide
AISGSGGSTYYADSVKG

SEQ ID NO: 4875 - protein, 17 aa, Artificial Sequence
  Description of Artificial Sequence: Synthetic peptide
RINPNSGDTHYAQKFQG

SEQ ID NO: 4876 - protein, 17 aa, Artificial Sequence
  Description of Artificial Sequence: Synthetic peptide
RINPNSGDTHYAQKFQG

SEQ ID NO: 4877 - protein, 16 aa, Artificial Sequence
  Description of Artificial Sequence: Synthetic peptide
YIYYSGSTYYNPSLKS

SEQ ID NO: 4878 - protein, 16 aa, Artificial Sequence
  Description of Artificial Sequence: Synthetic peptide
YIYYSGSTYYNPSLKS

SEQ ID NO: 4879 - protein, 7 aa, Artificial Sequence
  Description of Artificial Sequence: Synthetic peptide
GTKFLAP

SEQ ID NO: 4880 - protein, 7 aa, Artificial Sequence
  Description of Artificial Sequence: Synthetic peptide
GTKFLAP

SEQ ID NO: 4881 - protein, 7 aa, Artificial Sequence
  Description of Artificial Sequence: Synthetic peptide
GTKFLAP

SEQ ID NO: 4882 - protein, 7 aa, Artificial Sequence
  Description of Artificial Sequence: Synthetic peptide
GTKFLAP

SEQ ID NO: 4883 - protein, 7 aa, Artificial Sequence
  Description of Artificial Sequence: Synthetic peptide
GTKFLAP

SEQ ID NO: 4884 - protein, 7 aa, Artificial Sequence
  Description of Artificial Sequence: Synthetic peptide
GTKFLAP

SEQ ID NO: 4885 - protein, 7 aa, Artificial Sequence
  Description of Artificial Sequence: Synthetic peptide
GTKFLAP

SEQ ID NO: 4886 - protein, 7 aa, Artificial Sequence
  Description of Artificial Sequence: Synthetic peptide
GTKFLAP

SEQ ID NO: 4887 - protein, 7 aa, Artificial Sequence
  Description of Artificial Sequence: Synthetic peptide
GTKFLAP

SEQ ID NO: 4888 - protein, 7 aa, Artificial Sequence
  Description of Artificial Sequence: Synthetic peptide
GTKFLAP

SEQ ID NO: 4889 - protein, 7 aa, Artificial Sequence
  Description of Artificial Sequence: Synthetic peptide
GTKFLAP

SEQ ID NO: 4890 - protein, 7 aa, Artificial Sequence
  Description of Artificial Sequence: Synthetic peptide
GTKFLAP

SEQ ID NO: 4891 - protein, 7 aa, Artificial Sequence
  Description of Artificial Sequence: Synthetic peptide
GTKFLAP

SEQ ID NO: 4892 - protein, 7 aa, Artificial Sequence
  Description of Artificial Sequence: Synthetic peptide
GTKFLAP

SEQ ID NO: 4893 - protein, 7 aa, Artificial Sequence
  Description of Artificial Sequence: Synthetic peptide
GTKFLAP

SEQ ID NO: 4894 - protein, 7 aa, Artificial Sequence
  Description of Artificial Sequence: Synthetic peptide
GTKFLAP

SEQ ID NO: 4895 - protein, 7 aa, Artificial Sequence
  Description of Artificial Sequence: Synthetic peptide
GTKFLAP

SEQ ID NO: 4896 - protein, 7 aa, Artificial Sequence
  Description of Artificial Sequence: Synthetic peptide
GTKFLAP

SEQ ID NO: 4897 - protein, 7 aa, Artificial Sequence
  Description of Artificial Sequence: Synthetic peptide
GTKFLAP

SEQ ID NO: 4898 - protein, 7 aa, Artificial Sequence
  Description of Artificial Sequence: Synthetic peptide
GTKFLAP

SEQ ID NO: 4899 - protein, 7 aa, Artificial Sequence
  Description of Artificial Sequence: Synthetic peptide
GTKFLAP

SEQ ID NO: 4900 - protein, 7 aa, Artificial Sequence
  Description of Artificial Sequence: Synthetic peptide
GTKFLAP

SEQ ID NO: 4901 - protein, 7 aa, Artificial Sequence
  Description of Artificial Sequence: Synthetic peptide
GTKFLAP

SEQ ID NO: 4902 - protein, 7 aa, Artificial Sequence
  Description of Artificial Sequence: Synthetic peptide
GTKFLAP

SEQ ID NO: 4903 - protein, 19 aa, Artificial Sequence
  Description of Artificial Sequence: Synthetic peptide
RIRSKYNNYATYYADSVKD

SEQ ID NO: 4904 - protein, 19 aa, Artificial Sequence
  Description of Artificial Sequence: Synthetic peptide
RIRSKYNNYATYYADSVKD

SEQ ID NO: 4905 - protein, 19 aa, Artificial Sequence
  Description of Artificial Sequence: Synthetic peptide
RIRSKYNNYATYYADSVKD

SEQ ID NO: 4906 - protein, 19 aa, Artificial Sequence
  Description of Artificial Sequence: Synthetic peptide
RIRSKYNNYATYYADSVKD

SEQ ID NO: 4907 - protein, 19 aa, Artificial Sequence
  Description of Artificial Sequence: Synthetic peptide
RIRSKYNNYATYYADSVKD

SEQ ID NO: 4908 - protein, 19 aa, Artificial Sequence
  Description of Artificial Sequence: Synthetic peptide
RIRSKYNNYATYYADSVKD

SEQ ID NO: 4909 - protein, 19 aa, Artificial Sequence
  Description of Artificial Sequence: Synthetic peptide
RIRSKYNNYATYYADSVKD

SEQ ID NO: 4910 - protein, 19 aa, Artificial Sequence
  Description of Artificial Sequence: Synthetic peptide
RIRSKYNNYATYYADSVKD

SEQ ID NO: 4911 - protein, 19 aa, Artificial Sequence
  Description of Artificial Sequence: Synthetic peptide
RIRSKYNNYATYYADSVKD

SEQ ID NO: 4912 - protein, 19 aa, Artificial Sequence
  Description of Artificial Sequence: Synthetic peptide
RIRSKYNNYATYYADSVKD

SEQ ID NO: 4913 - protein, 19 aa, Artificial Sequence
  Description of Artificial Sequence: Synthetic peptide
RIRSKYNNYATYYADSVKD

SEQ ID NO: 4914 - protein, 19 aa, Artificial Sequence
  Description of Artificial Sequence: Synthetic peptide
RIRSKYNNYATYYADSVKD

SEQ ID NO: 4915 - protein, 19 aa, Artificial Sequence
  Description of Artificial Sequence: Synthetic peptide
RIRSKYNNYATYYADSVKD

SEQ ID NO: 4916 - protein, 19 aa, Artificial Sequence
  Description of Artificial Sequence: Synthetic peptide
RIRSKYNNYATYYADSVKD

SEQ ID NO: 4917 - protein, 19 aa, Artificial Sequence
  Description of Artificial Sequence: Synthetic peptide
RIRSKYNNYATYYADSVKD

SEQ ID NO: 4918 - protein, 19 aa, Artificial Sequence
  Description of Artificial Sequence: Synthetic peptide
RIRSKYNNYATYYADSVKD

SEQ ID NO: 4919 - protein, 19 aa, Artificial Sequence
  Description of Artificial Sequence: Synthetic peptide
RIRSKYNNYATYYADSVKD

SEQ ID NO: 4920 - protein, 19 aa, Artificial Sequence
  Description of Artificial Sequence: Synthetic peptide
RIRSKYNNYATYYADSVKD

SEQ ID NO: 4921 - protein, 19 aa, Artificial Sequence
  Description of Artificial Sequence: Synthetic peptide
RIRSKYNNYATYYADSVKD

SEQ ID NO: 4922 - protein, 19 aa, Artificial Sequence
  Description of Artificial Sequence: Synthetic peptide
RIRSKYNNYATYYADSVKD

SEQ ID NO: 4923 - protein, 19 aa, Artificial Sequence
  Description of Artificial Sequence: Synthetic peptide
RIRSKYNNYATYYADSVKD

SEQ ID NO: 4924 - protein, 19 aa, Artificial Sequence
  Description of Artificial Sequence: Synthetic peptide
RIRSKYNNYATYYADSVKD

SEQ ID NO: 4925 - protein, 19 aa, Artificial Sequence
  Description of Artificial Sequence: Synthetic peptide
RIRSKYNNYATYYADSVKD

SEQ ID NO: 4926 - protein, 19 aa, Artificial Sequence
  Description of Artificial Sequence: Synthetic peptide
RIRSKYNNYATYYADSVKD

SEQ ID NO: 4927 - protein, 9 aa, Artificial Sequence
  Description of Artificial Sequence: Synthetic peptide
QQYANSPLT

SEQ ID NO: 4928 - protein, 9 aa, Artificial Sequence
  Description of Artificial Sequence: Synthetic peptide
QQYANSPLT

SEQ ID NO: 4929 - protein, 9 aa, Artificial Sequence
  Description of Artificial Sequence: Synthetic peptide
QQSYSTPPT

SEQ ID NO: 4930 - protein, 9 aa, Artificial Sequence
  Description of Artificial Sequence: Synthetic peptide
QQSYSTPPT

SEQ ID NO: 4931 - protein, 9 aa, Artificial Sequence
  Description of Artificial Sequence: Synthetic peptide
QQYYSYPYT

SEQ ID NO: 4932 - protein, 9 aa, Artificial Sequence
  Description of Artificial Sequence: Synthetic peptide
QQYYSYPYT

SEQ ID NO: 4933 - protein, 9 aa, Artificial Sequence
  Description of Artificial Sequence: Synthetic peptide
HQWSSYPPT

SEQ ID NO: 4934 - protein, 9 aa, Artificial Sequence
  Description of Artificial Sequence: Synthetic peptide
HQWSSYPPT

SEQ ID NO: 4935 - protein, 9 aa, Artificial Sequence
  Description of Artificial Sequence: Synthetic peptide
QHHYGTPLT

SEQ ID NO: 4936 - protein, 9 aa, Artificial Sequence
  Description of Artificial Sequence: Synthetic peptide
QHHYGTPLT

SEQ ID NO: 4937 - protein, 9 aa, Artificial Sequence
  Description of Artificial Sequence: Synthetic peptide
MQALQTPPT

SEQ ID NO: 4938 - protein, 9 aa, Artificial Sequence
  Description of Artificial Sequence: Synthetic peptide
MQALQTPPT

SEQ ID NO: 4939 - protein, 9 aa, Artificial Sequence
  Description of Artificial Sequence: Synthetic peptide
QQYGSSPLT

SEQ ID NO: 4940 - protein, 9 aa, Artificial Sequence
  Description of Artificial Sequence: Synthetic peptide
QQYGSSPLT

SEQ ID NO: 4941 - protein, 9 aa, Artificial Sequence
  Description of Artificial Sequence: Synthetic peptide
MQALQTPLT

SEQ ID NO: 4942 - protein, 9 aa, Artificial Sequence
  Description of Artificial Sequence: Synthetic peptide
MQALQTPLT

SEQ ID NO: 4943 - protein, 9 aa, Artificial Sequence
  Description of Artificial Sequence: Synthetic peptide
MQALQTPFT

SEQ ID NO: 4944 - protein, 9 aa, Artificial Sequence
  Description of Artificial Sequence: Synthetic peptide
MQALQTPFT

SEQ ID NO: 4945 - protein, 9 aa, Artificial Sequence
  Description of Artificial Sequence: Synthetic peptide
QQSYRTPPT

SEQ ID NO: 4946 - protein, 9 aa, Artificial Sequence
  Description of Artificial Sequence: Synthetic peptide
QQSYRTPPT

SEQ ID NO: 4947 - protein, 9 aa, Artificial Sequence
  Description of Artificial Sequence: Synthetic peptide
QKYNSAPWT

SEQ ID NO: 4948 - protein, 9 aa, Artificial Sequence
  Description of Artificial Sequence: Synthetic peptide
QKYNSAPWT

SEQ ID NO: 4949 - protein, 9 aa, Artificial Sequence
  Description of Artificial Sequence: Synthetic peptide
MQALQTPIT

SEQ ID NO: 4950 - protein, 9 aa, Artificial Sequence
  Description of Artificial Sequence: Synthetic peptide
MQALQTPIT

SEQ ID NO: 4951 - protein, 11 aa, Artificial Sequence
  Description of Artificial Sequence: Synthetic peptide
DRIAVATYFDN

SEQ ID NO: 4952 - protein, 11 aa, Artificial Sequence
  Description of Artificial Sequence: Synthetic peptide
DRIAVATYFDN

SEQ ID NO: 4953 - protein, 12 aa, Artificial Sequence
  Description of Artificial Sequence: Synthetic peptide
MVTPDYYYDMDV

SEQ ID NO: 4954 - protein, 12 aa, Artificial Sequence
  Description of Artificial Sequence: Synthetic peptide
MVTPDYYYDMDV

SEQ ID NO: 4955 - protein, 10 aa, Artificial Sequence
  Description of Artificial Sequence: Synthetic peptide
DGVFYAPLAY

SEQ ID NO: 4956 - protein, 10 aa, Artificial Sequence
  Description of Artificial Sequence: Synthetic peptide
DGVFYAPLAY

SEQ ID NO: 4957 - protein, 13 aa, Artificial Sequence
  Description of Artificial Sequence: Synthetic peptide
GNYFGSSEAYFDY

SEQ ID NO: 4958 - protein, 13 aa, Artificial Sequence
  Description of Artificial Sequence: Synthetic peptide
GNYFGSSEAYFDY

SEQ ID NO: 4959 - protein, 11 aa, Artificial Sequence
  Description of Artificial Sequence: Synthetic peptide
RQLNHVFAMDY

SEQ ID NO: 4960 - protein, 11 aa, Artificial Sequence
  Description of Artificial Sequence: Synthetic peptide
RQLNHVFAMDY

SEQ ID NO: 4961 - protein, 14 aa, Artificial Sequence
  Description of Artificial Sequence: Synthetic peptide
GGGYSNGYDYGMDV

SEQ ID NO: 4962 - protein, 14 aa, Artificial Sequence
  Description of Artificial Sequence: Synthetic peptide
GGGYSNGYDYGMDV

SEQ ID NO: 4963 - protein, 12 aa, Artificial Sequence
  Description of Artificial Sequence: Synthetic peptide
EQWPNYYYGMDV

SEQ ID NO: 4964 - protein, 12 aa, Artificial Sequence
  Description of Artificial Sequence: Synthetic peptide
EQWPNYYYGMDV

SEQ ID NO: 4965 - protein, 16 aa, Artificial Sequence
  Description of Artificial Sequence: Synthetic peptide
EILWFGKLNYYYGMDV

SEQ ID NO: 4966 - protein, 16 aa, Artificial Sequence
  Description of Artificial Sequence: Synthetic peptide
EILWFGKLNYYYGMDV

SEQ ID NO: 4967 - protein, 14 aa, Artificial Sequence
  Description of Artificial Sequence: Synthetic peptide
GGGYSDGYDYGMDV

SEQ ID NO: 4968 - protein, 14 aa, Artificial Sequence
  Description of Artificial Sequence: Synthetic peptide
GGGYSDGYDYGMDV

SEQ ID NO: 4969 - protein, 12 aa, Artificial Sequence
  Description of Artificial Sequence: Synthetic peptide
MVTPDYYYDMDV

SEQ ID NO: 4970 - protein, 12 aa, Artificial Sequence
  Description of Artificial Sequence: Synthetic peptide
MVTPDYYYDMDV

SEQ ID NO: 4971 - protein, 9 aa, Artificial Sequence
  Description of Artificial Sequence: Synthetic peptide
GLGISFFDY

SEQ ID NO: 4972 - protein, 9 aa, Artificial Sequence
  Description of Artificial Sequence: Synthetic peptide
GLGISFFDY

SEQ ID NO: 4973 - protein, 16 aa, Artificial Sequence
  Description of Artificial Sequence: Synthetic peptide
DKLWFGKLNYYYGMDV

SEQ ID NO: 4974 - protein, 16 aa, Artificial Sequence
  Description of Artificial Sequence: Synthetic peptide
DKLWFGKLNYYYGMDV

SEQ ID NO: 4975 - protein, 9 aa, Artificial Sequence
  Description of Artificial Sequence: Synthetic peptide
VLWYSNRWV

SEQ ID NO: 4976 - protein, 9 aa, Artificial Sequence
  Description of Artificial Sequence: Synthetic peptide
VLWYSNRWV

SEQ ID NO: 4977 - protein, 9 aa, Artificial Sequence
  Description of Artificial Sequence: Synthetic peptide
VLWYSNRWV

SEQ ID NO: 4978 - protein, 9 aa, Artificial Sequence
  Description of Artificial Sequence: Synthetic peptide
VLWYSNRWV

SEQ ID NO: 4979 - protein, 9 aa, Artificial Sequence
  Description of Artificial Sequence: Synthetic peptide
VLWYSNRWV

SEQ ID NO: 4980 - protein, 9 aa, Artificial Sequence
  Description of Artificial Sequence: Synthetic peptide
VLWYSNRWV

SEQ ID NO: 4981 - protein, 9 aa, Artificial Sequence
  Description of Artificial Sequence: Synthetic peptide
VLWYSNRWV

SEQ ID NO: 4982 - protein, 9 aa, Artificial Sequence
  Description of Artificial Sequence: Synthetic peptide
VLWYSNRWV

SEQ ID NO: 4983 - protein, 9 aa, Artificial Sequence
  Description of Artificial Sequence: Synthetic peptide
VLWYSNRWV

SEQ ID NO: 4984 - protein, 9 aa, Artificial Sequence
  Description of Artificial Sequence: Synthetic peptide
VLWYSNRWV

SEQ ID NO: 4985 - protein, 9 aa, Artificial Sequence
  Description of Artificial Sequence: Synthetic peptide
VLWYSNRWV

SEQ ID NO: 4986 - protein, 9 aa, Artificial Sequence
  Description of Artificial Sequence: Synthetic peptide
VLWYSNRWV

SEQ ID NO: 4987 - protein, 9 aa, Artificial Sequence
  Description of Artificial Sequence: Synthetic peptide
VLWYSNRWV

SEQ ID NO: 4988 - protein, 9 aa, Artificial Sequence
  Description of Artificial Sequence: Synthetic peptide
VLWYSNRWV

SEQ ID NO: 4989 - protein, 9 aa, Artificial Sequence
  Description of Artificial Sequence: Synthetic peptide
VLWYSNRWV

SEQ ID NO: 4990 - protein, 9 aa, Artificial Sequence
  Description of Artificial Sequence: Synthetic peptide
VLWYSNRWV

SEQ ID NO: 4991 - protein, 9 aa, Artificial Sequence
  Description of Artificial Sequence: Synthetic peptide
VLWYSNRWV

SEQ ID NO: 4992 - protein, 9 aa, Artificial Sequence
  Description of Artificial Sequence: Synthetic peptide
VLWYSNRWV

SEQ ID NO: 4993 - protein, 9 aa, Artificial Sequence
  Description of Artificial Sequence: Synthetic peptide
VLWYSNRWV

SEQ ID NO: 4994 - protein, 9 aa, Artificial Sequence
  Description of Artificial Sequence: Synthetic peptide
VLWYSNRWV

SEQ ID NO: 4995 - protein, 9 aa, Artificial Sequence
  Description of Artificial Sequence: Synthetic peptide
VLWYSNRWV

SEQ ID NO: 4996 - protein, 9 aa, Artificial Sequence
  Description of Artificial Sequence: Synthetic peptide
VLWYSNRWV

SEQ ID NO: 4997 - protein, 9 aa, Artificial Sequence
  Description of Artificial Sequence: Synthetic peptide
VLWYSNRWV

SEQ ID NO: 4998 - protein, 9 aa, Artificial Sequence
  Description of Artificial Sequence: Synthetic peptide
VLWYSNRWV

SEQ ID NO: 4999 - protein, 14 aa, Artificial Sequence
  Description of Artificial Sequence: Synthetic peptide
HGNFGNSYISYWAY

SEQ ID NO: 5000 - protein, 14 aa, Artificial Sequence
  Description of Artificial Sequence: Synthetic peptide
HGNFGNSYISYWAY

SEQ ID NO: 5001 - protein, 14 aa, Artificial Sequence
  Description of Artificial Sequence: Synthetic peptide
HGNFGNSYISYWAY

SEQ ID NO: 5002 - protein, 14 aa, Artificial Sequence
  Description of Artificial Sequence: Synthetic peptide
HGNFGNSYISYWAY

SEQ ID NO: 5003 - protein, 14 aa, Artificial Sequence
  Description of Artificial Sequence: Synthetic peptide
HGNFGNSYISYWAY

SEQ ID NO: 5004 - protein, 14 aa, Artificial Sequence
  Description of Artificial Sequence: Synthetic peptide
HGNFGNSYISYWAY

SEQ ID NO: 5005 - protein, 14 aa, Artificial Sequence
  Description of Artificial Sequence: Synthetic peptide
HGNFGNSYISYWAY

SEQ ID NO: 5006 - protein, 14 aa, Artificial Sequence
  Description of Artificial Sequence: Synthetic peptide
HGNFGNSYISYWAY

SEQ ID NO: 5007 - protein, 14 aa, Artificial Sequence
  Description of Artificial Sequence: Synthetic peptide
HGNFGNSYISYWAY

SEQ ID NO: 5008 - protein, 14 aa, Artificial Sequence
  Description of Artificial Sequence: Synthetic peptide
HGNFGNSYISYWAY

SEQ ID NO: 5009 - protein, 14 aa, Artificial Sequence
  Description of Artificial Sequence: Synthetic peptide
HGNFGNSYISYWAY

SEQ ID NO: 5010 - protein, 14 aa, Artificial Sequence
  Description of Artificial Sequence: Synthetic peptide
HGNFGNSYISYWAY

SEQ ID NO: 5011 - protein, 14 aa, Artificial Sequence
  Description of Artificial Sequence: Synthetic peptide
HGNFGNSYISYWAY

SEQ ID NO: 5012 - protein, 14 aa, Artificial Sequence
  Description of Artificial Sequence: Synthetic peptide
HGNFGNSYISYWAY

SEQ ID NO: 5013 - protein, 14 aa, Artificial Sequence
  Description of Artificial Sequence: Synthetic peptide
HGNFGNSYISYWAY

SEQ ID NO: 5014 - protein, 14 aa, Artificial Sequence
  Description of Artificial Sequence: Synthetic peptide
HGNFGNSYISYWAY

SEQ ID NO: 5015 - protein, 14 aa, Artificial Sequence
  Description of Artificial Sequence: Synthetic peptide
HGNFGNSYISYWAY

SEQ ID NO: 5016 - protein, 14 aa, Artificial Sequence
  Description of Artificial Sequence: Synthetic peptide
HGNFGNSYISYWAY

SEQ ID NO: 5017 - protein, 14 aa, Artificial Sequence
  Description of Artificial Sequence: Synthetic peptide
HGNFGNSYISYWAY

SEQ ID NO: 5018 - protein, 14 aa, Artificial Sequence
  Description of Artificial Sequence: Synthetic peptide
HGNFGNSYISYWAY

SEQ ID NO: 5019 - protein, 14 aa, Artificial Sequence
  Description of Artificial Sequence: Synthetic peptide
HGNFGNSYISYWAY

SEQ ID NO: 5020 - protein, 14 aa, Artificial Sequence
  Description of Artificial Sequence: Synthetic peptide
HGNFGNSYISYWAY

SEQ ID NO: 5021 - protein, 14 aa, Artificial Sequence
  Description of Artificial Sequence: Synthetic peptide
HGNFGNSYISYWAY

SEQ ID NO: 5022 - protein, 14 aa, Artificial Sequence
  Description of Artificial Sequence: Synthetic peptide
HGNFGNSYISYWAY

SEQ ID NO: 5023 - protein, 108 aa, Artificial Sequence; identical to SEQ ID NO: 3979
  Description of Artificial Sequence: Synthetic polypeptide

SEQ ID NO: 5024 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYANSPLTFGGGTKVEIK

SEQ ID NO: 5025 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDFATYYCQQSYSTPPTFGCGTKVEIK

SEQ ID NO: 5026 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDFATYYCQQSYSTPPTFGQGTKVEIK

SEQ ID NO: 5027 - protein, 113 aa, Artificial Sequence; identical to SEQ ID NO: 3981
  Description of Artificial Sequence: Synthetic polypeptide

SEQ ID NO: 5028 - protein, 113 aa, Artificial Sequence
  Description of Artificial Sequence: Synthetic polypeptide
ELVMTQSPSSLAVSVGEKITMSCKSSQSLLYSSNQKNYLAWYQQKPGQSPKLLIYWASTRESGVPDRFTGSGSGTDFTLTISSVKAEDLAVYYCQQYYSYPYTFGGGTKLELK

SEQ ID NO: 5029 - protein, 106 aa, Artificial Sequence; identical to SEQ ID NO: 3982
  Description of Artificial Sequence: Synthetic polypeptide

SEQ ID NO: 5030 - protein, 106 aa, Artificial Sequence
  Description of Artificial Sequence: Synthetic polypeptide
ELVLTQSPAIMSASPGQKVTITCSASSNVNYIHWYQQKLGSSPKLWIYDTSKLAPGVPARFSGSGSGTSYSLTISSMEAEDAASYFCHQWSSYPPTFGSGTKLEIK

SEQ ID NO: 5031 - protein, 107 aa, Artificial Sequence; identical to SEQ ID NO: 3983
  Description of Artificial Sequence: Synthetic polypeptide

SEQ ID NO: 5032 - protein, 107 aa, Artificial Sequence
  Description of Artificial Sequence: Synthetic polypeptide
ELQMTQSPASLSASVGETVTITCRASGNIHNYLAWYQQKQGKSPQLLVYNAKTLAGGVPSRFSGSGSGTQFSLKINSLQPEDFGSYYCQHHYGTPLTFGAGTKLELK

SEQ ID NO: 5033 - protein, 112 aa, Artificial Sequence; identical to SEQ ID NO: 3984
  Description of Artificial Sequence: Synthetic polypeptide

SEQ ID NO: 5034 - protein, 112 aa, Artificial Sequence
  Description of Artificial Sequence: Synthetic polypeptide
DIVMTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPPTFGQGTRLEIK

SEQ ID NO: 5035 - protein, 108 aa, Artificial Sequence; identical to SEQ ID NO: 3986
  Description of Artificial Sequence: Synthetic polypeptide

SEQ ID NO: 5036 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 5037 - protein, 112 aa, Artificial Sequence
  Description of Artificial Sequence: Synthetic polypeptide
DIVLTQSPLSLPVTPGDPASISCRSSQSLLHSNGYNYLDWYLQKPGQSPQLLIYLGSNRASGVPDRFSGSGSGTDFTLKISRVEAEDVGVYYCMQALQTPLTFGCGTKVDIK

SEQ ID NO: 5038 - protein, 112 aa, Artificial Sequence
  Description of Artificial Sequence: Synthetic polypeptide
DIVLTQSPLSLPVTPGDPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 5039 - protein, 112 aa, Artificial Sequence
  Description of Artificial Sequence: Synthetic polypeptide
DIVLTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPFTFGCGTKVEIK

SEQ ID NO: 5040 - protein, 112 aa, Artificial Sequence
  Description of Artificial Sequence: Synthetic polypeptide
DIVLTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPFTFGPGTKVEIK

SEQ ID NO: 5041 - protein, 107 aa, Artificial Sequence
  Description of Artificial Sequence: Synthetic polypeptide
DIQMTQSPSSVSASVGDRVTITCRASQSISSYLNWYQQKPGKAPKSLIYAASSLQSGVPSRFSGSGSGTDFTLTISSLQPEDFATYYCQQSYRTPPTFGCGTKVDIK

SEQ ID NO: 5042 - protein, 107 aa, Artificial Sequence
  Description of Artificial Sequence: Synthetic polypeptide
DIQMTQSPSSVSASVGDRVTITCRASQSISSYLNWYQQKPGKAPKSLIYAASSLQSGVPSRFSGSGSGTDFTLTISSLQPEDFATYYCQQSYRTPPTFGQGTKVDIK

SEQ ID NO: 5043 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPWTFGCGTKLEIK

SEQ ID NO: 5044 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPWTFGQGTKLEIK

SEQ ID NO: 5045 - protein, 112 aa, Artificial Sequence
  Description of Artificial Sequence: Synthetic polypeptide
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGCGTRLEIK

SEQ ID NO: 5046 - protein, 112 aa, Artificial Sequence
  Description of Artificial Sequence: Synthetic polypeptide
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK

SEQ ID NO: 5047 - protein, 120 aa, Artificial Sequence; identical to SEQ ID NO: 3987
  Description of Artificial Sequence: Synthetic polypeptide

SEQ ID NO: 5048 - protein, 120 aa, Artificial Sequence
  Description of Artificial Sequence: Synthetic polypeptide
EVQLVESGGGLVKPGGSLRLSCAASGFTFSTYSMNWVRQAPGKGLEWVSSISSSSSYIYYADSVKGRFTISRDNAKNSLYLQMNSLRDEDTAVYYCARDRIAVATYFDNWGQGTLVTVSS

SEQ ID NO: 5049 - protein, 121 aa, Artificial Sequence
  Description of Artificial Sequence: Synthetic polypeptide
EVQLLESGGGLVQPGGSLRLSCAASGFTFSSFAMSWVRQAPGKCLEWVSAISGSGGSTYYADSVKGRFTISRDNSKNTLYLQMNSLRAEDTAEYYCAKMVTPDYYYDMDVWGQGTTVTVSS

SEQ ID NO: 5050 - protein, 121 aa, Artificial Sequence
  Description of Artificial Sequence: Synthetic polypeptide
EVQLLESGGGLVQPGGSLRLSCAASGFTFSSFAMSWVRQAPGKGLEWVSAISGSGGSTYYADSVKGRFTISRDNSKNTLYLQMNSLRAEDTAEYYCAKMVTPDYYYDMDVWGQGTTVTVSS

SEQ ID NO: 5051 - protein, 119 aa, Artificial Sequence; identical to SEQ ID NO: 3989
  Description of Artificial Sequence: Synthetic polypeptide

SEQ ID NO: 5052 - protein, 119 aa, Artificial Sequence
  Description of Artificial Sequence: Synthetic polypeptide
VQLLEQSGPELVKPGASVKISCKASGYAFSKSWMNWVKQRPGKGLEWIGRIYPGDGDTNYNGKFKGKAALTADKSSNTANMQLNSLTSEDSAVYFCARDGVFYAPLAYWGQGTLVTVSS

SEQ ID NO: 5053 - protein, 122 aa, Artificial Sequence; identical to SEQ ID NO: 3990
  Description of Artificial Sequence: Synthetic polypeptide

SEQ ID NO: 5054 - protein, 122 aa, Artificial Sequence
  Description of Artificial Sequence: Synthetic polypeptide
VQLLEQSGPELVKPGASVKISCKASDYTFSKSWMNWVKQRPGEGLEWIGRVWPGDGDTTYNEKFKGKATLTADKSSRTAYMQLSSLTSEDSAVYFCARGNYFGSSEAYFDYWGQGTRVTVSS

SEQ ID NO: 5055 - protein, 120 aa, Artificial Sequence; identical to SEQ ID NO: 3991
  Description of Artificial Sequence: Synthetic polypeptide

SEQ ID NO: 5056 - protein, 120 aa, Artificial Sequence
  Description of Artificial Sequence: Synthetic polypeptide
VQLLEQSGPELVKPGASVKISCKASGYAFSSSWMNWVKQRPGKGLEWIGRIYPGDGDTNYNGKFKDKATLTADKSSNTAYMQLSSLTSEDSAVYFCARRQLNHVFAMDYWGQGTSVTVSS

SEQ ID NO: 5057 - protein, 123 aa, Artificial Sequence; identical to SEQ ID NO: 3992
  Description of Artificial Sequence: Synthetic polypeptide

SEQ ID NO: 5058 - protein, 123 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGGGYSNGYDYGMDVWGQGTTVTVSS

SEQ ID NO: 5059 - protein, 121 aa, Artificial Sequence; identical to SEQ ID NO: 3994
  Description of Artificial Sequence: Synthetic polypeptide

SEQ ID NO: 5060 - protein, 121 aa, Artificial Sequence
  Description of Artificial Sequence: Synthetic polypeptide
QVQLVESGGGVVQPGRSLRLSCAASGFTFRSYRMHWVRQAPGKGLEWVAVISYDGGNKYYADSVKGRFTISRDNSKNTLYLQMNSLRAEDTAVYYCAREQWPNYYYGMDVWGQGTTVTVSS

SEQ ID NO: 5061 - protein, 128 aa, Artificial Sequence
  Description of Artificial Sequence: Synthetic polypeptide
QVQLQQSGPGLVKPSQTLSLTCAISGDSVSSNSAAWNWIRQSPSRCLEWLGRTYYRSKWYNDYAVSVKSRITINPDTSKNQFSLQLNSVTPEDTAVYYCVREILWFGKLNYYYGMDVWGQGTTVTVSS

SEQ ID NO: 5062 - protein, 128 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCVREILWFGKLNYYYGMDVWGQGTTVTVSS

SEQ ID NO: 5063 - protein, 122 aa, Artificial Sequence
  Description of Artificial Sequence: Synthetic polypeptide
QVQLQQWGAGLLKPSETLSLTCAVYGGSFSGYYWNWIRQPPGKCLEWIGEINHRGSTNYNPSLKSRVTISVDASKNQFSLKLSSVTAADTAVYYCARGGGYSDGYDYGMDVWGQGTTVTVSS

SEQ ID NO: 5064 - protein, 122 aa, Artificial Sequence
  Description of Artificial Sequence: Synthetic polypeptide
QVQLQQWGAGLLKPSETLSLTCAVYGGSFSGYYWNWIRQPPGKGLEWIGEINHRGSTNYNPSLKSRVTISVDASKNQFSLKLSSVTAADTAVYYCARGGGYSDGYDYGMDVWGQGTTVTVSS

SEQ ID NO: 5065 - protein, 121 aa, Artificial Sequence; identical to SEQ ID NO: 5049
  Description of Artificial Sequence: Synthetic polypeptide

SEQ ID NO: 5066 - protein, 121 aa, Artificial Sequence; identical to SEQ ID NO: 5050
  Description of Artificial Sequence: Synthetic polypeptide

SEQ ID NO: 5067 - protein, 118 aa, Artificial Sequence
  Description of Artificial Sequence: Synthetic polypeptide
QVQLVQSGAEVKKPGASVKVSCKASGYSFTGYYMHWVRQAPGQCLEWMGRINPNSGDTHYAQKFQGRVTMTRDTSISTAYMELSRLRSDDTAVYYCARGLGISFFDYWGQGTLVTVSS

SEQ ID NO: 5068 - protein, 118 aa, Artificial Sequence
  Description of Artificial Sequence: Synthetic polypeptide
QVQLVQSGAEVKKPGASVKVSCKASGYSFTGYYMHWVRQAPGQGLEWMGRINPNSGDTHYAQKFQGRVTMTRDTSISTAYMELSRLRSDDTAVYYCARGLGISFFDYWGQGTLVTVSS

SEQ ID NO: 5069 - protein, 126 aa, Artificial Sequence
  Description of Artificial Sequence: Synthetic polypeptide
QVQLQESGPGLVKPSQTLSLTCTVSGDSISRDPYYWSWIRQHPGKCLEWIGYIYYSGSTYYNPSLKSRVTISVDTSKNQFSLKLSSVTAADTAVYYCARDKLWFGKLNYYYGMDVWGQGTTVTVSS

SEQ ID NO: 5070 - protein, 126 aa, Artificial Sequence
  Description of Artificial Sequence: Synthetic polypeptide
QVQLQESGPGLVKPSQTLSLTCTVSGDSISRDPYYWSWIRQHPGKGLEWIGYIYYSGSTYYNPSLKSRVTISVDTSKNQFSLKLSSVTAADTAVYYCARDKLWFGKLNYYYGMDVWGQGTTVTVSS

SEQ ID NO: 5071 - protein, 109 aa, Artificial Sequence; identical to SEQ ID NO: 31
  Description of Artificial Sequence: Synthetic polypeptide

SEQ ID NO: 5072 - protein, 109 aa, Artificial Sequence; identical to SEQ ID NO: 31
  Description of Artificial Sequence: Synthetic polypeptide

SEQ ID NO: 5073 - protein, 109 aa, Artificial Sequence; identical to SEQ ID NO: 31
  Description of Artificial Sequence: Synthetic polypeptide

SEQ ID NO: 5074 - protein, 109 aa, Artificial Sequence; identical to SEQ ID NO: 31
  Description of Artificial Sequence: Synthetic polypeptide

SEQ ID NO: 5075 - protein, 109 aa, Artificial Sequence; identical to SEQ ID NO: 31
  Description of Artificial Sequence: Synthetic polypeptide

SEQ ID NO: 5076 - protein, 109 aa, Artificial Sequence; identical to SEQ ID NO: 31
  Description of Artificial Sequence: Synthetic polypeptide

SEQ ID NO: 5077 - protein, 109 aa, Artificial Sequence; identical to SEQ ID NO: 31
  Description of Artificial Sequence: Synthetic polypeptide

SEQ ID NO: 5078 - protein, 109 aa, Artificial Sequence; identical to SEQ ID NO: 31
  Description of Artificial Sequence: Synthetic polypeptide

SEQ ID NO: 5079 - protein, 109 aa, Artificial Sequence; identical to SEQ ID NO: 31
  Description of Artificial Sequence: Synthetic polypeptide

SEQ ID NO: 5080 - protein, 109 aa, Artificial Sequence; identical to SEQ ID NO: 31
  Description of Artificial Sequence: Synthetic polypeptide

SEQ ID NO: 5081 - protein, 109 aa, Artificial Sequence; identical to SEQ ID NO: 31
  Description of Artificial Sequence: Synthetic polypeptide

SEQ ID NO: 5082 - protein, 109 aa, Artificial Sequence; identical to SEQ ID NO: 31
  Description of Artificial Sequence: Synthetic polypeptide

SEQ ID NO: 5083 - protein, 109 aa, Artificial Sequence; identical to SEQ ID NO: 31
  Description of Artificial Sequence: Synthetic polypeptide

SEQ ID NO: 5084 - protein, 109 aa, Artificial Sequence; identical to SEQ ID NO: 31
  Description of Artificial Sequence: Synthetic polypeptide

SEQ ID NO: 5085 - protein, 109 aa, Artificial Sequence; identical to SEQ ID NO: 31
  Description of Artificial Sequence: Synthetic polypeptide

SEQ ID NO: 5086 - protein, 109 aa, Artificial Sequence; identical to SEQ ID NO: 31
  Description of Artificial Sequence: Synthetic polypeptide

SEQ ID NO: 5087 - protein, 109 aa, Artificial Sequence; identical to SEQ ID NO: 31
  Description of Artificial Sequence: Synthetic polypeptide

SEQ ID NO: 5088 - protein, 109 aa, Artificial Sequence; identical to SEQ ID NO: 31
  Description of Artificial Sequence: Synthetic polypeptide

SEQ ID NO: 5089 - protein, 109 aa, Artificial Sequence; identical to SEQ ID NO: 31
  Description of Artificial Sequence: Synthetic polypeptide

SEQ ID NO: 5090 - protein, 109 aa, Artificial Sequence; identical to SEQ ID NO: 31
  Description of Artificial Sequence: Synthetic polypeptide

SEQ ID NO: 5091 - protein, 109 aa, Artificial Sequence; identical to SEQ ID NO: 31
  Description of Artificial Sequence: Synthetic polypeptide

SEQ ID NO: 5092 - protein, 109 aa, Artificial Sequence; identical to SEQ ID NO: 31
  Description of Artificial Sequence: Synthetic polypeptide

SEQ ID NO: 5093 - protein, 109 aa, Artificial Sequence; identical to SEQ ID NO: 31
  Description of Artificial Sequence: Synthetic polypeptide

SEQ ID NO: 5094 - protein, 109 aa, Artificial Sequence; identical to SEQ ID NO: 31
  Description of Artificial Sequence: Synthetic polypeptide

SEQ ID NO: 5095 - protein, 125 aa, Artificial Sequence; identical to SEQ ID NO: 697
  Description of Artificial Sequence: Synthetic polypeptide

SEQ ID NO: 5096 - protein, 125 aa, Artificial Sequence; identical to SEQ ID NO: 697
  Description of Artificial Sequence: Synthetic polypeptide

SEQ ID NO: 5097 - protein, 125 aa, Artificial Sequence; identical to SEQ ID NO: 697
  Description of Artificial Sequence: Synthetic polypeptide

SEQ ID NO: 5098 - protein, 125 aa, Artificial Sequence; identical to SEQ ID NO: 697
  Description of Artificial Sequence: Synthetic polypeptide

SEQ ID NO: 5099 - protein, 125 aa, Artificial Sequence; identical to SEQ ID NO: 697
  Description of Artificial Sequence: Synthetic polypeptide

SEQ ID NO: 5100 - protein, 125 aa, Artificial Sequence; identical to SEQ ID NO: 697
  Description of Artificial Sequence: Synthetic polypeptide

SEQ ID NO: 5101 - protein, 125 aa, Artificial Sequence; identical to SEQ ID NO: 697
  Description of Artificial Sequence: Synthetic polypeptide

SEQ ID NO: 5102 - protein, 125 aa, Artificial Sequence; identical to SEQ ID NO: 697
  Description of Artificial Sequence: Synthetic polypeptide

SEQ ID NO: 5103 - protein, 125 aa, Artificial Sequence; identical to SEQ ID NO: 697
  Description of Artificial Sequence: Synthetic polypeptide

SEQ ID NO: 5104 - protein, 125 aa, Artificial Sequence; identical to SEQ ID NO: 697
  Description of Artificial Sequence: Synthetic polypeptide

SEQ ID NO: 5105 - protein, 125 aa, Artificial Sequence; identical to SEQ ID NO: 697
  Description of Artificial Sequence: Synthetic polypeptide

SEQ ID NO: 5106 - protein, 125 aa, Artificial Sequence; identical to SEQ ID NO: 697
  Description of Artificial Sequence: Synthetic polypeptide

SEQ ID NO: 5107 - protein, 125 aa, Artificial Sequence; identical to SEQ ID NO: 697
  Description of Artificial Sequence: Synthetic polypeptide

SEQ ID NO: 5108 - protein, 125 aa, Artificial Sequence; identical to SEQ ID NO: 697
  Description of Artificial Sequence: Synthetic polypeptide

SEQ ID NO: 5109 - protein, 125 aa, Artificial Sequence; identical to SEQ ID NO: 697
  Description of Artificial Sequence: Synthetic polypeptide

SEQ ID NO: 5110 - protein, 125 aa, Artificial Sequence; identical to SEQ ID NO: 697
  Description of Artificial Sequence: Synthetic polypeptide

SEQ ID NO: 5111 - protein, 125 aa, Artificial Sequence; identical to SEQ ID NO: 697
  Description of Artificial Sequence: Synthetic polypeptide

SEQ ID NO: 5112 - protein, 125 aa, Artificial Sequence; identical to SEQ ID NO: 697
  Description of Artificial Sequence: Synthetic polypeptide

SEQ ID NO: 5113 - protein, 125 aa, Artificial Sequence; identical to SEQ ID NO: 697
  Description of Artificial Sequence: Synthetic polypeptide

SEQ ID NO: 5114 - protein, 125 aa, Artificial Sequence; identical to SEQ ID NO: 697
  Description of Artificial Sequence: Synthetic polypeptide

SEQ ID NO: 5115 - protein, 125 aa, Artificial Sequence; identical to SEQ ID NO: 697
  Description of Artificial Sequence: Synthetic polypeptide

SEQ ID NO: 5116 - protein, 125 aa, Artificial Sequence; identical to SEQ ID NO: 697
  Description of Artificial Sequence: Synthetic polypeptide

SEQ ID NO: 5117 - protein, 125 aa, Artificial Sequence; identical to SEQ ID NO: 697
  Description of Artificial Sequence: Synthetic polypeptide

SEQ ID NO: 5118 - protein, 125 aa, Artificial Sequence; identical to SEQ ID NO: 697
  Description of Artificial Sequence: Synthetic polypeptide

SEQ ID NO: 5119 - protein, 23 aa, Artificial Sequence
  Description of Artificial Sequence: Synthetic peptide
EIVLTQSPGTLSLSPGERATLSC

SEQ ID NO: 5120 - protein, 23 aa, Artificial Sequence
  Description of Artificial Sequence: Synthetic peptide
EIVLTQSPGTLSLSPGERATLSC

SEQ ID NO: 5121 - protein, 23 aa, Artificial Sequence
  Description of Artificial Sequence: Synthetic peptide
EIVLTQSPGTLSLSPGERATLSC

SEQ ID NO: 5122 - protein, 23 aa, Artificial Sequence
  Description of Artificial Sequence: Synthetic peptide
EIVLTQSPGTLSLSPGERATLSC

SEQ ID NO: 5123 - protein, 23 aa, Artificial Sequence
  Description of Artificial Sequence: Synthetic peptide
DIQMTQSPSSLSASVGDRVTITC

SEQ ID NO: 5124 - protein, 23 aa, Artificial Sequence
  Description of Artificial Sequence: Synthetic peptide
DIQMTQSPSSLSASVGDRVTITC

SEQ ID NO: 5125 - protein, 23 aa, Artificial Sequence
  Description of Artificial Sequence: Synthetic peptide
DIQMTQSPSSLSASVGDRVTITC

SEQ ID NO: 5126 - protein, 23 aa, Artificial Sequence
  Description of Artificial Sequence: Synthetic peptide
DIVMTQSPDSLAVSLGERATINC

SEQ ID NO: 5127 - protein, 23 aa, Artificial Sequence
  Description of Artificial Sequence: Synthetic peptide
ELVMTQSPSSLAVSVGEKITMSC

SEQ ID NO: 5128 - protein, 23 aa, Artificial Sequence
  Description of Artificial Sequence: Synthetic peptide
ELVMTQSPSSLAVSVGEKITMSC

SEQ ID NO: 5129 - protein, 23 aa, Artificial Sequence
  Description of Artificial Sequence: Synthetic peptide
EIVLTQSPDFQSVTPKEKVTITC

SEQ ID NO: 5130 - protein, 23 aa, Artificial Sequence
  Description of Artificial Sequence: Synthetic peptide
ELVLTQSPAIMSASPGQKVTITC

SEQ ID NO: 5131 - protein, 23 aa, Artificial Sequence
  Description of Artificial Sequence: Synthetic peptide
ELVLTQSPAIMSASPGQKVTITC

SEQ ID NO: 5132 - protein, 23 aa, Artificial Sequence
  Description of Artificial Sequence: Synthetic peptide
AIQMTQSPSSLSASVGDRVTITC

SEQ ID NO: 5133 - protein, 23 aa, Artificial Sequence
  Description of Artificial Sequence: Synthetic peptide
ELQMTQSPASLSASVGETVTITC

SEQ ID NO: 5134 - protein, 23 aa, Artificial Sequence
  Description of Artificial Sequence: Synthetic peptide
ELQMTQSPASLSASVGETVTITC

SEQ ID NO: 5135 - protein, 23 aa, Artificial Sequence
  Description of Artificial Sequence: Synthetic peptide
DIVMTQSPLSLPVTPGEPASISC

SEQ ID NO: 5136 - protein, 23 aa, Artificial Sequence
  Description of Artificial Sequence: Synthetic peptide
DIVMTQSPLSLPVSPGEPASISC

SEQ ID NO: 5137 - protein, 23 aa, Artificial Sequence
  Description of Artificial Sequence: Synthetic peptide
DIVMTQSPLSLPVSPGEPASISC

SEQ ID NO: 5138 - protein, 23 aa, Artificial Sequence
  Description of Artificial Sequence: Synthetic peptide
EIVLTQSPGTLSLSPGERATLSC

SEQ ID NO: 5139 - protein, 23 aa, Artificial Sequence
  Description of Artificial Sequence: Synthetic peptide
EIVLTQSPGTLSLSPGERATLSC

SEQ ID NO: 5140 - protein, 23 aa, Artificial Sequence
  Description of Artificial Sequence: Synthetic peptide
DIVMTQSPLSLPVTPGEPASISC

SEQ ID NO: 5141 - protein, 23 aa, Artificial Sequence
  Description of Artificial Sequence: Synthetic peptide
DIVLTQSPLSLPVTPGDPASISC

SEQ ID NO: 5142 - protein, 23 aa, Artificial Sequence
  Description of Artificial Sequence: Synthetic peptide
DIVLTQSPLSLPVSPGEPASISC

SEQ ID NO: 5143 - protein, 23 aa, Artificial Sequence
  Description of Artificial Sequence: Synthetic peptide
DIVMTQSPLSLPVTPGEPASISC

SEQ ID NO: 5144 - protein, 23 aa, Artificial Sequence
  Description of Artificial Sequence: Synthetic peptide
DIVLTQSPLSLPVTPGDPASISC

SEQ ID NO: 5145 - protein, 23 aa, Artificial Sequence
  Description of Artificial Sequence: Synthetic peptide
DIVMTQSPLSLPVTPGEPASISC

SEQ ID NO: 5146 - protein, 23 aa, Artificial Sequence
  Description of Artificial Sequence: Synthetic peptide
DIVLTQSPLSLPVSPGEPASISC

SEQ ID NO: 5147 - protein, 23 aa, Artificial Sequence
  Description of Artificial Sequence: Synthetic peptide
DIQMTQSPSSVSASVGDRVTITC

SEQ ID NO: 5148 - protein, 23 aa, Artificial Sequence
  Description of Artificial Sequence: Synthetic peptide
DIQMTQSPSSVSASVGDRVTITC

SEQ ID NO: 5149 - protein, 23 aa, Artificial Sequence
  Description of Artificial Sequence: Synthetic peptide
DIQMTQSPSSVSASVGDRVTITC

SEQ ID NO: 5150 - protein, 23 aa, Artificial Sequence
  Description of Artificial Sequence: Synthetic peptide
DIQMTQSPSSVSASVGDRVTITC

SEQ ID NO: 5151 - protein, 23 aa, Artificial Sequence
  Description of Artificial Sequence: Synthetic peptide
DIQMTQSPSSLSASVGDRVTITC

SEQ ID NO: 5152 - protein, 23 aa, Artificial Sequence
  Description of Artificial Sequence: Synthetic peptide
DIQMTQSPSSLSASVGDRVTITC

SEQ ID NO: 5153 - protein, 23 aa, Artificial Sequence
  Description of Artificial Sequence: Synthetic peptide
DIQMTQSPSSLSASVGDRVTITC

SEQ ID NO: 5154 - protein, 23 aa, Artificial Sequence
  Description of Artificial Sequence: Synthetic peptide
DIVMTQTPLSLPVTPGEPASISC

SEQ ID NO: 5155 - protein, 23 aa, Artificial Sequence
  Description of Artificial Sequence: Synthetic peptide
DIVMTQTPLSLPVTPGEPASISC

SEQ ID NO: 5156 - protein, 23 aa, Artificial Sequence
  Description of Artificial Sequence: Synthetic peptide
DIVMTQTPLSLPVTPGEPASISC

SEQ ID NO: 5157 - protein, 22 aa, Artificial Sequence
  Description of Artificial Sequence: Synthetic peptide
QTVVTQEPSLTVSPGGTVTLTC

SEQ ID NO: 5158 - protein, 22 aa, Artificial Sequence
  Description of Artificial Sequence: Synthetic peptide
QTVVTQEPSLTVSPGGTVTLTC

SEQ ID NO: 5159 - protein, 22 aa, Artificial Sequence
  Description of Artificial Sequence: Synthetic peptide
QTVVTQEPSLTVSPGGTVTLTC

SEQ ID NO: 5160 - protein, 22 aa, Artificial Sequence
  Description of Artificial Sequence: Synthetic peptide
QTVVTQEPSLTVSPGGTVTLTC

SEQ ID NO: 5161 - protein, 22 aa, Artificial Sequence
  Description of Artificial Sequence: Synthetic peptide
QTVVTQEPSLTVSPGGTVTLTC

SEQ ID NO: 5162 - protein, 22 aa, Artificial Sequence
  Description of Artificial Sequence: Synthetic peptide
QTVVTQEPSLTVSPGGTVTLTC

SEQ ID NO: 5163 - protein, 22 aa, Artificial Sequence
  Description of Artificial Sequence: Synthetic peptide
QTVVTQEPSLTVSPGGTVTLTC

SEQ ID NO: 5164 - protein, 22 aa, Artificial Sequence
  Description of Artificial Sequence: Synthetic peptide
QTVVTQEPSLTVSPGGTVTLTC

SEQ ID NO: 5165 - protein, 22 aa, Artificial Sequence
  Description of Artificial Sequence: Synthetic peptide
QTVVTQEPSLTVSPGGTVTLTC

SEQ ID NO: 5166 - protein, 22 aa, Artificial Sequence
  Description of Artificial Sequence: Synthetic peptide
QTVVTQEPSLTVSPGGTVTLTC

SEQ ID NO: 5167 - protein, 22 aa, Artificial Sequence
  Description of Artificial Sequence: Synthetic peptide
QTVVTQEPSLTVSPGGTVTLTC

SEQ ID NO: 5168 - protein, 22 aa, Artificial Sequence
  Description of Artificial Sequence: Synthetic peptide
QTVVTQEPSLTVSPGGTVTLTC

SEQ ID NO: 5169 - protein, 22 aa, Artificial Sequence
  Description of Artificial Sequence: Synthetic peptide
QTVVTQEPSLTVSPGGTVTLTC

SEQ ID NO: 5170 - protein, 22 aa, Artificial Sequence
  Description of Artificial Sequence: Synthetic peptide
QTVVTQEPSLTVSPGGTVTLTC

SEQ ID NO: 5171 - protein, 22 aa, Artificial Sequence
  Description of Artificial Sequence: Synthetic peptide
QTVVTQEPSLTVSPGGTVTLTC

SEQ ID NO: 5172 - protein, 22 aa, Artificial Sequence
  Description of Artificial Sequence: Synthetic peptide
QTVVTQEPSLTVSPGGTVTLTC

SEQ ID NO: 5173 - protein, 22 aa, Artificial Sequence
  Description of Artificial Sequence: Synthetic peptide
QTVVTQEPSLTVSPGGTVTLTC

SEQ ID NO: 5174 - protein, 22 aa, Artificial Sequence
  Description of Artificial Sequence: Synthetic peptide
QTVVTQEPSLTVSPGGTVTLTC

SEQ ID NO: 5175 - protein, 22 aa, Artificial Sequence
  Description of Artificial Sequence: Synthetic peptide
QTVVTQEPSLTVSPGGTVTLTC

SEQ ID NO: 5176 - protein, 22 aa, Artificial Sequence
  Description of Artificial Sequence: Synthetic peptide
QTVVTQEPSLTVSPGGTVTLTC

SEQ ID NO: 5177 - protein, 22 aa, Artificial Sequence
  Description of Artificial Sequence: Synthetic peptide
QTVVTQEPSLTVSPGGTVTLTC

SEQ ID NO: 5178 - protein, 22 aa, Artificial Sequence
  Description of Artificial Sequence: Synthetic peptide
QTVVTQEPSLTVSPGGTVTLTC

SEQ ID NO: 5179 - protein, 22 aa, Artificial Sequence
  Description of Artificial Sequence: Synthetic peptide
QTVVTQEPSLTVSPGGTVTLTC

SEQ ID NO: 5180 - protein, 22 aa, Artificial Sequence
  Description of Artificial Sequence: Synthetic peptide
QTVVTQEPSLTVSPGGTVTLTC

SEQ ID NO: 5181 - protein, 22 aa, Artificial Sequence
  Description of Artificial Sequence: Synthetic peptide
QTVVTQEPSLTVSPGGTVTLTC

SEQ ID NO: 5182 - protein, 30 aa, Artificial Sequence; identical to SEQ ID NO: 832
  Description of Artificial Sequence: Synthetic polypeptide

SEQ ID NO: 5183 - protein, 30 aa, Artificial Sequence; identical to SEQ ID NO: 832
  Description of Artificial Sequence: Synthetic polypeptide

SEQ ID NO: 5184 - protein, 30 aa, Artificial Sequence; identical to SEQ ID NO: 832
  Description of Artificial Sequence: Synthetic polypeptide

SEQ ID NO: 5185 - protein, 30 aa, Artificial Sequence; identical to SEQ ID NO: 793
  Description of Artificial Sequence: Synthetic polypeptide

SEQ ID NO: 5186 - protein, 30 aa, Artificial Sequence; identical to SEQ ID NO: 794
  Description of Artificial Sequence: Synthetic polypeptide

SEQ ID NO: 5187 - protein, 30 aa, Artificial Sequence; identical to SEQ ID NO: 794
  Description of Artificial Sequence: Synthetic polypeptide

SEQ ID NO: 5188 - protein, 30 aa, Artificial Sequence; identical to SEQ ID NO: 794
  Description of Artificial Sequence: Synthetic polypeptide

SEQ ID NO: 5189 - protein, 30 aa, Artificial Sequence; identical to SEQ ID NO: 794
  Description of Artificial Sequence: Synthetic polypeptide

SEQ ID NO: 5190 - protein, 30 aa, Artificial Sequence; identical to SEQ ID NO: 794
  Description of Artificial Sequence: Synthetic polypeptide

SEQ ID NO: 5191 - protein, 30 aa, Artificial Sequence; identical to SEQ ID NO: 794
  Description of Artificial Sequence: Synthetic polypeptide

SEQ ID NO: 5192 - protein, 30 aa, Artificial Sequence; identical to SEQ ID NO: 794
  Description of Artificial Sequence: Synthetic polypeptide

SEQ ID NO: 5193 - protein, 30 aa, Artificial Sequence; identical to SEQ ID NO: 794
  Description of Artificial Sequence: Synthetic polypeptide

SEQ ID NO: 5194 - protein, 30 aa, Artificial Sequence; identical to SEQ ID NO: 794
  Description of Artificial Sequence: Synthetic polypeptide

SEQ ID NO: 5195 - protein, 30 aa, Artificial Sequence; identical to SEQ ID NO: 794
  Description of Artificial Sequence: Synthetic polypeptide

SEQ ID NO: 5196 - protein, 30 aa, Artificial Sequence; identical to SEQ ID NO: 794
  Description of Artificial Sequence: Synthetic polypeptide

SEQ ID NO: 5197 - protein, 30 aa, Artificial Sequence; identical to SEQ ID NO: 794
  Description of Artificial Sequence: Synthetic polypeptide

SEQ ID NO: 5198 - protein, 30 aa, Artificial Sequence; identical to SEQ ID NO: 794
  Description of Artificial Sequence: Synthetic polypeptide

SEQ ID NO: 5199 - protein, 30 aa, Artificial Sequence; identical to SEQ ID NO: 794
  Description of Artificial Sequence: Synthetic polypeptide

SEQ ID NO: 5200 - protein, 30 aa, Artificial Sequence; identical to SEQ ID NO: 794
  Description of Artificial Sequence: Synthetic polypeptide

SEQ ID NO: 5201 - protein, 30 aa, Artificial Sequence; identical to SEQ ID NO: 794
  Description of Artificial Sequence: Synthetic polypeptide

SEQ ID NO: 5202 - protein, 30 aa, Artificial Sequence; identical to SEQ ID NO: 794
  Description of Artificial Sequence: Synthetic polypeptide

SEQ ID NO: 5203 - protein, 30 aa, Artificial Sequence; identical to SEQ ID NO: 794
  Description of Artificial Sequence: Synthetic polypeptide

SEQ ID NO: 5204 - protein, 30 aa, Artificial Sequence; identical to SEQ ID NO: 794
  Description of Artificial Sequence: Synthetic polypeptide

SEQ ID NO: 5205 - protein, 30 aa, Artificial Sequence; identical to SEQ ID NO: 794
  Description of Artificial Sequence: Synthetic polypeptide

SEQ ID NO: 5206 - protein, 30 aa, Artificial Sequence; identical to SEQ ID NO: 794
  Description of Artificial Sequence: Synthetic polypeptide

SEQ ID NO: 5207 - protein, 30 aa, Artificial Sequence; identical to SEQ ID NO: 794
  Description of Artificial Sequence: Synthetic polypeptide

SEQ ID NO: 5208 - protein, 30 aa, Artificial Sequence; identical to SEQ ID NO: 794
  Description of Artificial Sequence: Synthetic polypeptide

SEQ ID NO: 5209 - protein, 30 aa, Artificial Sequence; identical to SEQ ID NO: 794
  Description of Artificial Sequence: Synthetic polypeptide

SEQ ID NO: 5210 - protein, 30 aa, Artificial Sequence; identical to SEQ ID NO: 779
  Description of Artificial Sequence: Synthetic polypeptide

SEQ ID NO: 5211 - protein, 30 aa, Artificial Sequence; identical to SEQ ID NO: 779
  Description of Artificial Sequence: Synthetic polypeptide

SEQ ID NO: 5212 - protein, 30 aa, Artificial Sequence; identical to SEQ ID NO: 779
  Description of Artificial Sequence: Synthetic polypeptide

SEQ ID NO: 5213 - protein, 30 aa, Artificial Sequence; identical to SEQ ID NO: 779
  Description of Artificial Sequence: Synthetic polypeptide

SEQ ID NO: 5214 - protein, 30 aa, Artificial Sequence; identical to SEQ ID NO: 779
  Description of Artificial Sequence: Synthetic polypeptide

SEQ ID NO: 5215 - protein, 30 aa, Artificial Sequence; identical to SEQ ID NO: 4049
  Description of Artificial Sequence: Synthetic polypeptide

SEQ ID NO: 5216 - protein, 30 aa, Artificial Sequence; identical to SEQ ID NO: 4050
  Description of Artificial Sequence: Synthetic polypeptide

SEQ ID NO: 5217 - protein, 30 aa, Artificial Sequence; identical to SEQ ID NO: 4050
  Description of Artificial Sequence: Synthetic polypeptide

SEQ ID NO: 5218 - protein, 30 aa, Artificial Sequence; identical to SEQ ID NO: 4049
  Description of Artificial Sequence: Synthetic polypeptide

SEQ ID NO: 5219 - protein, 30 aa, Artificial Sequence; identical to SEQ ID NO: 4052
  Description of Artificial Sequence: Synthetic polypeptide

SEQ ID NO: 5220 - protein, 30 aa, Artificial Sequence; identical to SEQ ID NO: 4052
  Description of Artificial Sequence: Synthetic polypeptide

SEQ ID NO: 5221 - protein, 30 aa, Artificial Sequence; identical to SEQ ID NO: 4049
  Description of Artificial Sequence: Synthetic polypeptide

SEQ ID NO: 5222 - protein, 30 aa, Artificial Sequence; identical to SEQ ID NO: 4050
  Description of Artificial Sequence: Synthetic polypeptide

SEQ ID NO: 5223 - protein, 30 aa, Artificial Sequence; identical to SEQ ID NO: 4050
  Description of Artificial Sequence: Synthetic polypeptide

SEQ ID NO: 5224 - protein, 30 aa, Artificial Sequence; identical to SEQ ID NO: 3145
  Description of Artificial Sequence: Synthetic polypeptide

SEQ ID NO: 5225 - protein, 30 aa, Artificial Sequence; identical to SEQ ID NO: 3145
  Description of Artificial Sequence: Synthetic polypeptide

SEQ ID NO: 5226 - protein, 30 aa, Artificial Sequence; identical to SEQ ID NO: 3145
  Description of Artificial Sequence: Synthetic polypeptide

SEQ ID NO: 5227 - protein, 30 aa, Artificial Sequence; identical to SEQ ID NO: 853
  Description of Artificial Sequence: Synthetic polypeptide

SEQ ID NO: 5228 - protein, 30 aa, Artificial Sequence; identical to SEQ ID NO: 4060
  Description of Artificial Sequence: Synthetic polypeptide

SEQ ID NO: 5229 - protein, 30 aa, Artificial Sequence; identical to SEQ ID NO: 4060
  Description of Artificial Sequence: Synthetic polypeptide

SEQ ID NO: 5230 - protein, 30 aa, Artificial Sequence
  Description of Artificial Sequence: Synthetic polypeptide
QVQLQQSGPGLVKPSQTLSLTCAISGDSVS

SEQ ID NO: 5231 - protein, 30 aa, Artificial Sequence; identical to SEQ ID NO: 5230
  Description of Artificial Sequence: Synthetic polypeptide

SEQ ID NO: 5232 - protein, 30 aa, Artificial Sequence; identical to SEQ ID NO: 5230
  Description of Artificial Sequence: Synthetic polypeptide

SEQ ID NO: 5233 - protein, 30 aa, Artificial Sequence; identical to SEQ ID NO: 4057
  Description of Artificial Sequence: Synthetic polypeptide

SEQ ID NO: 5234 - protein, 30 aa, Artificial Sequence; identical to SEQ ID NO: 4057
  Description of Artificial Sequence: Synthetic polypeptide

SEQ ID NO: 5235 - protein, 30 aa, Artificial Sequence; identical to SEQ ID NO: 4057
  Description of Artificial Sequence: Synthetic polypeptide

SEQ ID NO: 5236 - protein, 30 aa, Artificial Sequence; identical to SEQ ID NO: 3145
  Description of Artificial Sequence: Synthetic polypeptide

SEQ ID NO: 5237 - protein, 30 aa, Artificial Sequence
  Description of Artificial Sequence: Synthetic polypeptide
QVQLVQSGAEVKKPGASVKVSCKASGYSFT

SEQ ID NO: 5238 - protein, 30 aa, Artificial Sequence; identical to SEQ ID NO: 5237
  Description of Artificial Sequence: Synthetic polypeptide

SEQ ID NO: 5239 - protein, 30 aa, Artificial Sequence; identical to SEQ ID NO: 858
  Description of Artificial Sequence: Synthetic polypeptide

SEQ ID NO: 5240 - protein, 30 aa, Artificial Sequence; identical to SEQ ID NO: 859
  Description of Artificial Sequence: Synthetic polypeptide

SEQ ID NO: 5241 - protein, 30 aa, Artificial Sequence; identical to SEQ ID NO: 859
  Description of Artificial Sequence: Synthetic polypeptide

SEQ ID NO: 5242 - protein, 12 aa, Artificial Sequence
  Description of Artificial Sequence: Synthetic peptide
RASQSVSSSYLA

SEQ ID NO: 5243 - protein, 12 aa, Artificial Sequence
  Description of Artificial Sequence: Synthetic peptide
RASQSVSSSYLA

SEQ ID NO: 5244 - protein, 12 aa, Artificial Sequence
  Description of Artificial Sequence: Synthetic peptide
RASQSVSSSYLA

SEQ ID NO: 5245 - protein, 12 aa, Artificial Sequence
  Description of Artificial Sequence: Synthetic peptide
RASQSVSSSYLA

SEQ ID NO: 5246 - protein, 11 aa, Artificial Sequence
  Description of Artificial Sequence: Synthetic peptide
RASQGISNYLA

SEQ ID NO: 5247 - protein, 11 aa, Artificial Sequence
  Description of Artificial Sequence: Synthetic peptide
RASQGISNYLA

SEQ ID NO: 5248 - protein, 11 aa, Artificial Sequence
  Description of Artificial Sequence: Synthetic peptide
RASQGISNYLA

SEQ ID NO: 5249 - protein, 17 aa, Artificial Sequence
  Description of Artificial Sequence: Synthetic peptide
KSSQSVLYSSNNKNYLA

SEQ ID NO: 5250 - protein, 17 aa, Artificial Sequence
  Description of Artificial Sequence: Synthetic peptide
KSSQSLLYSSNQKNYLA

SEQ ID NO: 5251 - protein, 17 aa, Artificial Sequence
  Description of Artificial Sequence: Synthetic peptide
KSSQSLLYSSNQKNYLA

SEQ ID NO: 5252 - protein, 11 aa, Artificial Sequence
  Description of Artificial Sequence: Synthetic peptide
RASQSIGSSLH

SEQ ID NO: 5253 - protein, 10 aa, Artificial Sequence
  Description of Artificial Sequence: Synthetic peptide
SASSNVNYIH

SEQ ID NO: 5254 - protein, 10 aa, Artificial Sequence
  Description of Artificial Sequence: Synthetic peptide
SASSNVNYIH

SEQ ID NO: 5255 - protein, 11 aa, Artificial Sequence
  Description of Artificial Sequence: Synthetic peptide
RASQGIRNDLG

SEQ ID NO: 5256 - protein, 11 aa, Artificial Sequence
  Description of Artificial Sequence: Synthetic peptide
RASGNIHNYLA

SEQ ID NO: 5257 - protein, 11 aa, Artificial Sequence
  Description of Artificial Sequence: Synthetic peptide
RASGNIHNYLA

SEQ ID NO: 5258 - protein, 16 aa, Artificial Sequence
  Description of Artificial Sequence: Synthetic peptide
RSSQSLLHSNGYNYLD

SEQ ID NO: 5259 - protein, 16 aa, Artificial Sequence
  Description of Artificial Sequence: Synthetic peptide
RSSQSLLYSNGYNYVD

SEQ ID NO: 5260 - protein, 16 aa, Artificial Sequence
  Description of Artificial Sequence: Synthetic peptide
RSSQSLLYSNGYNYVD

SEQ ID NO: 5261 - protein, 12 aa, Artificial Sequence
  Description of Artificial Sequence: Synthetic peptide
RASQSVSSSYLA

SEQ ID NO: 5262 - protein, 12 aa, Artificial Sequence
  Description of Artificial Sequence: Synthetic peptide
RASQSVSSSYLA

SEQ ID NO: 5263 - protein, 16 aa, Artificial Sequence
  Description of Artificial Sequence: Synthetic peptide
RSSQSLLHSNGYNYLD

SEQ ID NO: 5264 - protein, 16 aa, Artificial Sequence
  Description of Artificial Sequence: Synthetic peptide
RSSQSLLHSNGYNYLD

SEQ ID NO: 5265 - protein, 16 aa, Artificial Sequence
  Description of Artificial Sequence: Synthetic peptide
RSSQSLLYSNGYNYVD

SEQ ID NO: 5266 - protein, 16 aa, Artificial Sequence
  Description of Artificial Sequence: Synthetic peptide
RSSQSLLHSNGYNYLD

SEQ ID NO: 5267 - protein, 16 aa, Artificial Sequence
  Description of Artificial Sequence: Synthetic peptide
RSSQSLLHSNGYNYLD

SEQ ID NO: 5268 - protein, 16 aa, Artificial Sequence
  Description of Artificial Sequence: Synthetic peptide
RSSQSLLHSNGYNYLD

SEQ ID NO: 5269 - protein, 16 aa, Artificial Sequence
  Description of Artificial Sequence: Synthetic peptide
RSSQSLLYSNGYNYVD

SEQ ID NO: 5270 - protein, 11 aa, Artificial Sequence
  Description of Artificial Sequence: Synthetic peptide
RASQGISSWLA

SEQ ID NO: 5271 - protein, 11 aa, Artificial Sequence
  Description of Artificial Sequence: Synthetic peptide
RASQSISSYLN

SEQ ID NO: 5272 - protein, 11 aa, Artificial Sequence
  Description of Artificial Sequence: Synthetic peptide
RASQGISSWLA

SEQ ID NO: 5273 - protein, 11 aa, Artificial Sequence
  Description of Artificial Sequence: Synthetic peptide
RASQSISSYLN

SEQ ID NO: 5274 - protein, 11 aa, Artificial Sequence
  Description of Artificial Sequence: Synthetic peptide
RASQGISNYLA

SEQ ID NO: 5275 - protein, 11 aa, Artificial Sequence
  Description of Artificial Sequence: Synthetic peptide
RASQGISNYLA

SEQ ID NO: 5276 - protein, 11 aa, Artificial Sequence
  Description of Artificial Sequence: Synthetic peptide
RASQGISNYLA

SEQ ID NO: 5277 - protein, 17 aa, Artificial Sequence
  Description of Artificial Sequence: Synthetic peptide
RSSQSLLDSDDGNTYLD

SEQ ID NO: 5278 - protein, 16 aa, Artificial Sequence
  Description of Artificial Sequence: Synthetic peptide
RSSQSLLHSNGYNYLD

SEQ ID NO: 5279 - protein, 16 aa, Artificial Sequence
  Description of Artificial Sequence: Synthetic peptide
RSSQSLLHSNGYNYLD

SEQ ID NO: 5280 - protein, 14 aa, Artificial Sequence
  Description of Artificial Sequence: Synthetic peptide
ASSTGAVTSGYYPN

SEQ ID NO: 5281 - protein, 14 aa, Artificial Sequence
  Description of Artificial Sequence: Synthetic peptide
GSSTGAVTSGNYPN

SEQ ID NO: 5282 - protein, 14 aa, Artificial Sequence
  Description of Artificial Sequence: Synthetic peptide
GSSTGAVTSGNYPN

SEQ ID NO: 5283 - protein, 14 aa, Artificial Sequence
  Description of Artificial Sequence: Synthetic peptide
GSSTGAVTSGNYPN

SEQ ID NO: 5284 - protein, 14 aa, Artificial Sequence
  Description of Artificial Sequence: Synthetic peptide
GSSTGAVTSGNYPN

SEQ ID NO: 5285 - protein, 14 aa, Artificial Sequence
  Description of Artificial Sequence: Synthetic peptide
GSSTGAVTSGNYPN

SEQ ID NO: 5286 - protein, 14 aa, Artificial Sequence
  Description of Artificial Sequence: Synthetic peptide
GSSTGAVTSGNYPN

SEQ ID NO: 5287 - protein, 14 aa, Artificial Sequence
  Description of Artificial Sequence: Synthetic peptide
GSSTGAVTSGNYPN

SEQ ID NO: 5288 - protein, 14 aa, Artificial Sequence
  Description of Artificial Sequence: Synthetic peptide
GSSTGAVTSGNYPN

SEQ ID NO: 5289 - protein, 14 aa, Artificial Sequence
  Description of Artificial Sequence: Synthetic peptide
GSSTGAVTSGNYPN

SEQ ID NO: 5290 - protein, 14 aa, Artificial Sequence
  Description of Artificial Sequence: Synthetic peptide
GSSTGAVTSGNYPN

SEQ ID NO: 5291 - protein, 14 aa, Artificial Sequence
  Description of Artificial Sequence: Synthetic peptide
GSSTGAVTSGNYPN

SEQ ID NO: 5292 - protein, 14 aa, Artificial Sequence
  Description of Artificial Sequence: Synthetic peptide
GSSTGAVTSGNYPN

SEQ ID NO: 5293 - protein, 14 aa, Artificial Sequence
  Description of Artificial Sequence: Synthetic peptide
GSSTGAVTSGNYPN

SEQ ID NO: 5294 - protein, 14 aa, Artificial Sequence
  Description of Artificial Sequence: Synthetic peptide
GSSTGAVTSGNYPN

SEQ ID NO: 5295 - protein, 14 aa, Artificial Sequence
  Description of Artificial Sequence: Synthetic peptide
GSSTGAVTSGNYPN

SEQ ID NO: 5296 - protein, 14 aa, Artificial Sequence
  Description of Artificial Sequence: Synthetic peptide
GSSTGAVTSGNYPN

SEQ ID NO: 5297 - protein, 14 aa, Artificial Sequence
  Description of Artificial Sequence: Synthetic peptide
GSSTGAVTSGNYPN

SEQ ID NO: 5298 - protein, 14 aa, Artificial Sequence
  Description of Artificial Sequence: Synthetic peptide
GSSTGAVTSGNYPN

SEQ ID NO: 5299 - protein, 14 aa, Artificial Sequence
  Description of Artificial Sequence: Synthetic peptide
GSSTGAVTSGNYPN

SEQ ID NO: 5300 - protein, 14 aa, Artificial Sequence
  Description of Artificial Sequence: Synthetic peptide
GSSTGAVTSGNYPN

SEQ ID NO: 5301 - protein, 14 aa, Artificial Sequence
  Description of Artificial Sequence: Synthetic peptide
GSSTGAVTSGNYPN

SEQ ID NO: 5302 - protein, 14 aa, Artificial Sequence
  Description of Artificial Sequence: Synthetic peptide
GSSTGAVTSGNYPN

SEQ ID NO: 5303 - protein, 14 aa, Artificial Sequence
  Description of Artificial Sequence: Synthetic peptide
GSSTGAVTSGNYPN

SEQ ID NO: 5304 - protein, 14 aa, Artificial Sequence
  Description of Artificial Sequence: Synthetic peptide
GSSTGAVTSGNYPN

SEQ ID NO: 5305 - protein, 5 aa, Artificial Sequence
  Description of Artificial Sequence: Synthetic peptide
SYSMN

SEQ ID NO: 5306 - protein, 5 aa, Artificial Sequence
  Description of Artificial Sequence: Synthetic peptide
TYSMN

SEQ ID NO: 5307 - protein, 5 aa, Artificial Sequence
  Description of Artificial Sequence: Synthetic peptide
TYSMN

SEQ ID NO: 5308 - protein, 5 aa, Artificial Sequence
  Description of Artificial Sequence: Synthetic peptide
GSAMH

SEQ ID NO: 5309 - protein, 5 aa, Artificial Sequence
  Description of Artificial Sequence: Synthetic peptide
KYAMN

SEQ ID NO: 5310 - protein, 5 aa, Artificial Sequence
  Description of Artificial Sequence: Synthetic peptide
KYAMN

SEQ ID NO: 5311 - protein, 5 aa, Artificial Sequence
  Description of Artificial Sequence: Synthetic peptide
KYAMN

SEQ ID NO: 5312 - protein, 5 aa, Artificial Sequence
  Description of Artificial Sequence: Synthetic peptide
KYAMN

SEQ ID NO: 5313 - protein, 5 aa, Artificial Sequence
  Description of Artificial Sequence: Synthetic peptide
KYAMN

SEQ ID NO: 5314 - protein, 5 aa, Artificial Sequence
  Description of Artificial Sequence: Synthetic peptide
KYAMN

SEQ ID NO: 5315 - protein, 5 aa, Artificial Sequence
  Description of Artificial Sequence: Synthetic peptide
KYAMN

SEQ ID NO: 5316 - protein, 5 aa, Artificial Sequence
  Description of Artificial Sequence: Synthetic peptide
KYAMN

SEQ ID NO: 5317 - protein, 5 aa, Artificial Sequence
  Description of Artificial Sequence: Synthetic peptide
KYAMN

SEQ ID NO: 5318 - protein, 5 aa, Artificial Sequence
  Description of Artificial Sequence: Synthetic peptide
KYAMN

SEQ ID NO: 5319 - protein, 5 aa, Artificial Sequence
  Description of Artificial Sequence: Synthetic peptide
KYAMN

SEQ ID NO: 5320 - protein, 5 aa, Artificial Sequence
  Description of Artificial Sequence: Synthetic peptide
KYAMN

SEQ ID NO: 5321 - protein, 5 aa, Artificial Sequence
  Description of Artificial Sequence: Synthetic peptide
KYAMN

SEQ ID NO: 5322 - protein, 5 aa, Artificial Sequence
  Description of Artificial Sequence: Synthetic peptide
KYAMN

SEQ ID NO: 5323 - protein, 5 aa, Artificial Sequence
  Description of Artificial Sequence: Synthetic peptide
KYAMN

SEQ ID NO: 5324 - protein, 5 aa, Artificial Sequence
  Description of Artificial Sequence: Synthetic peptide
KYAMN

SEQ ID NO: 5325 - protein, 5 aa, Artificial Sequence
  Description of Artificial Sequence: Synthetic peptide
KYAMN

SEQ ID NO: 5326 - protein, 5 aa, Artificial Sequence
  Description of Artificial Sequence: Synthetic peptide
KYAMN

SEQ ID NO: 5327 - protein, 5 aa, Artificial Sequence
  Description of Artificial Sequence: Synthetic peptide
KYAMN

SEQ ID NO: 5328 - protein, 5 aa, Artificial Sequence
  Description of Artificial Sequence: Synthetic peptide
KYAMN

SEQ ID NO: 5329 - protein, 5 aa, Artificial Sequence
  Description of Artificial Sequence: Synthetic peptide
KYAMN

SEQ ID NO: 5330 - protein, 5 aa, Artificial Sequence
  Description of Artificial Sequence: Synthetic peptide
KYAMN

SEQ ID NO: 5331 - protein, 5 aa, Artificial Sequence
  Description of Artificial Sequence: Synthetic peptide
KYAMN

SEQ ID NO: 5332 - protein, 5 aa, Artificial Sequence
  Description of Artificial Sequence: Synthetic peptide
KYAMN

SEQ ID NO: 5333 - protein, 5 aa, Artificial Sequence
  Description of Artificial Sequence: Synthetic peptide
SYAMS

SEQ ID NO: 5334 - protein, 5 aa, Artificial Sequence
  Description of Artificial Sequence: Synthetic peptide
SFAMS

SEQ ID NO: 5335 - protein, 5 aa, Artificial Sequence
  Description of Artificial Sequence: Synthetic peptide
SFAMS

SEQ ID NO: 5336 - protein, 5 aa, Artificial Sequence
  Description of Artificial Sequence: Synthetic peptide
SFAMS

SEQ ID NO: 5337 - protein, 5 aa, Artificial Sequence
  Description of Artificial Sequence: Synthetic peptide
SFAMS

SEQ ID NO: 5338 - protein, 5 aa, Artificial Sequence
  Description of Artificial Sequence: Synthetic peptide
SYAIS

SEQ ID NO: 5339 - protein, 5 aa, Artificial Sequence
  Description of Artificial Sequence: Synthetic peptide
KSWMN

SEQ ID NO: 5340 - protein, 5 aa, Artificial Sequence
  Description of Artificial Sequence: Synthetic peptide
KSWMN

SEQ ID NO: 5341 - protein, 5 aa, Artificial Sequence
  Description of Artificial Sequence: Synthetic peptide
SYAIS

SEQ ID NO: 5342 - protein, 5 aa, Artificial Sequence
  Description of Artificial Sequence: Synthetic peptide
KSWMN

SEQ ID NO: 5343 - protein, 5 aa, Artificial Sequence
  Description of Artificial Sequence: Synthetic peptide
KSWMN

SEQ ID NO: 5344 - protein, 5 aa, Artificial Sequence
  Description of Artificial Sequence: Synthetic peptide
SYAIS

SEQ ID NO: 5345 - protein, 5 aa, Artificial Sequence
  Description of Artificial Sequence: Synthetic peptide
SSWMN

SEQ ID NO: 5346 - protein, 5 aa, Artificial Sequence
  Description of Artificial Sequence: Synthetic peptide
SSWMN

SEQ ID NO: 5347 - protein, 5 aa, Artificial Sequence
  Description of Artificial Sequence: Synthetic peptide
SYDIN

SEQ ID NO: 5348 - protein, 5 aa, Artificial Sequence
  Description of Artificial Sequence: Synthetic peptide
SYDIN

SEQ ID NO: 5349 - protein, 5 aa, Artificial Sequence
  Description of Artificial Sequence: Synthetic peptide
SYDIN

SEQ ID NO: 5350 - protein, 5 aa, Artificial Sequence
  Description of Artificial Sequence: Synthetic peptide
SYAMH

SEQ ID NO: 5351 - protein, 5 aa, Artificial Sequence
  Description of Artificial Sequence: Synthetic peptide
SYRMH

SEQ ID NO: 5352 - protein, 5 aa, Artificial Sequence
  Description of Artificial Sequence: Synthetic peptide
SYRMH

SEQ ID NO: 5353 - protein, 7 aa, Artificial Sequence
  Description of Artificial Sequence: Synthetic peptide
SNSAAWN

SEQ ID NO: 5354 - protein, 7 aa, Artificial Sequence
  Description of Artificial Sequence: Synthetic peptide
SNSAAWN

SEQ ID NO: 5355 - protein, 7 aa, Artificial Sequence
  Description of Artificial Sequence: Synthetic peptide
SNSAAWN

SEQ ID NO: 5356 - protein, 5 aa, Artificial Sequence
  Description of Artificial Sequence: Synthetic peptide
GYYWS

SEQ ID NO: 5357 - protein, 5 aa, Artificial Sequence
  Description of Artificial Sequence: Synthetic peptide
GYYWN

SEQ ID NO: 5358 - protein, 5 aa, Artificial Sequence
  Description of Artificial Sequence: Synthetic peptide
GYYWN

SEQ ID NO: 5359 - protein, 5 aa, Artificial Sequence
  Description of Artificial Sequence: Synthetic peptide
GYYMH

SEQ ID NO: 5360 - protein, 5 aa, Artificial Sequence
  Description of Artificial Sequence: Synthetic peptide
GYYMH

SEQ ID NO: 5361 - protein, 5 aa, Artificial Sequence
  Description of Artificial Sequence: Synthetic peptide
GYYMH

SEQ ID NO: 5362 - protein, 7 aa, Artificial Sequence
  Description of Artificial Sequence: Synthetic peptide
SGGYYWS

SEQ ID NO: 5363 - protein, 7 aa, Artificial Sequence
  Description of Artificial Sequence: Synthetic peptide
RDPYYWS

SEQ ID NO: 5364 - protein, 7 aa, Artificial Sequence
  Description of Artificial Sequence: Synthetic peptide
RDPYYWS

SEQ ID NO: 5365 - protein, 15 aa, Artificial Sequence
  Description of Artificial Sequence: Synthetic peptide
WYQQKPGQAPRLLIY

SEQ ID NO: 5366 - protein, 15 aa, Artificial Sequence
  Description of Artificial Sequence: Synthetic peptide
WYQQKPGQAPRLLIY

SEQ ID NO: 5367 - protein, 15 aa, Artificial Sequence
  Description of Artificial Sequence: Synthetic peptide
WYQQKPGQAPRLLIY

SEQ ID NO: 5368 - protein, 15 aa, Artificial Sequence
  Description of Artificial Sequence: Synthetic peptide
WYQQKPGQAPRLLIY

SEQ ID NO: 5369 - protein, 15 aa, Artificial Sequence
  Description of Artificial Sequence: Synthetic peptide
WYQQKPGKVPKLLIY

SEQ ID NO: 5370 - protein, 15 aa, Artificial Sequence
  Description of Artificial Sequence: Synthetic peptide
WYQQKPGKVPKLLIY

SEQ ID NO: 5371 - protein, 15 aa, Artificial Sequence
  Description of Artificial Sequence: Synthetic peptide
WYQQKPGKVPKLLIY

SEQ ID NO: 5372 - protein, 15 aa, Artificial Sequence
  Description of Artificial Sequence: Synthetic peptide
WYQQKPGQPPKLLIY

SEQ ID NO: 5373 - protein, 15 aa, Artificial Sequence
  Description of Artificial Sequence: Synthetic peptide
WYQQKPGQSPKLLIY

SEQ ID NO: 5374 - protein, 15 aa, Artificial Sequence
  Description of Artificial Sequence: Synthetic peptide
WYQQKPGQSPKLLIY

SEQ ID NO: 5375 - protein, 15 aa, Artificial Sequence
  Description of Artificial Sequence: Synthetic peptide
WYQQKPDQSPKLLIK

SEQ ID NO: 5376 - protein, 15 aa, Artificial Sequence
  Description of Artificial Sequence: Synthetic peptide
WYQQKLGSSPKLWIY

SEQ ID NO: 5377 - protein, 15 aa, Artificial Sequence
  Description of Artificial Sequence: Synthetic peptide
WYQQKLGSSPKLWIY

SEQ ID NO: 5378 - protein, 15 aa, Artificial Sequence
  Description of Artificial Sequence: Synthetic peptide
WYQQKPGKAPKLLIY

SEQ ID NO: 5379 - protein, 15 aa, Artificial Sequence
  Description of Artificial Sequence: Synthetic peptide
WYQQKQGKSPQLLVY

SEQ ID NO: 5380 - protein, 15 aa, Artificial Sequence
  Description of Artificial Sequence: Synthetic peptide
WYQQKQGKSPQLLVY

SEQ ID NO: 5381 - protein, 15 aa, Artificial Sequence
  Description of Artificial Sequence: Synthetic peptide
WYLQKPGQSPQLLIY

SEQ ID NO: 5382 - protein, 15 aa, Artificial Sequence
  Description of Artificial Sequence: Synthetic peptide
WYLQKPGQSPQLLIY

SEQ ID NO: 5383 - protein, 15 aa, Artificial Sequence
  Description of Artificial Sequence: Synthetic peptide
WYLQKPGQSPQLLIY

SEQ ID NO: 5384 - protein, 15 aa, Artificial Sequence
  Description of Artificial Sequence: Synthetic peptide
WYQQKPGQAPRLLIY

SEQ ID NO: 5385 - protein, 15 aa, Artificial Sequence
  Description of Artificial Sequence: Synthetic peptide
WYQQKPGQAPRLLIY

SEQ ID NO: 5386 - protein, 15 aa, Artificial Sequence
  Description of Artificial Sequence: Synthetic peptide
WYLQKPGQSPQLLIY

SEQ ID NO: 5387 - protein, 15 aa, Artificial Sequence
  Description of Artificial Sequence: Synthetic peptide
WYLQKPGQSPQLLIY

SEQ ID NO: 5388 - protein, 15 aa, Artificial Sequence
  Description of Artificial Sequence: Synthetic peptide
WYLQKPGQSPQLLIY

SEQ ID NO: 5389 - protein, 15 aa, Artificial Sequence
  Description of Artificial Sequence: Synthetic peptide
WYLQKPGQSPQLLIY

SEQ ID NO: 5390 - protein, 15 aa, Artificial Sequence
  Description of Artificial Sequence: Synthetic peptide
WYLQKPGQSPQLLIY

SEQ ID NO: 5391 - protein, 15 aa, Artificial Sequence
  Description of Artificial Sequence: Synthetic peptide
WYLQKPGQSPQLLIY

SEQ ID NO: 5392 - protein, 15 aa, Artificial Sequence
  Description of Artificial Sequence: Synthetic peptide
WYLQKPGQSPQLLIY

SEQ ID NO: 5393 - protein, 15 aa, Artificial Sequence
  Description of Artificial Sequence: Synthetic peptide
WYQQKPGKAPKLLIY

SEQ ID NO: 5394 - protein, 15 aa, Artificial Sequence
  Description of Artificial Sequence: Synthetic peptide
WYQQKPGKAPKSLIY

SEQ ID NO: 5395 - protein, 15 aa, Artificial Sequence
  Description of Artificial Sequence: Synthetic peptide
WYQQKPGKAPKLLIY

SEQ ID NO: 5396 - protein, 15 aa, Artificial Sequence
  Description of Artificial Sequence: Synthetic peptide
WYQQKPGKAPKSLIY

SEQ ID NO: 5397 - protein, 15 aa, Artificial Sequence
  Description of Artificial Sequence: Synthetic peptide
WYQQKPGKVPKLLIY

SEQ ID NO: 5398 - protein, 15 aa, Artificial Sequence
  Description of Artificial Sequence: Synthetic peptide
WYQQKPGKVPKLLIY

SEQ ID NO: 5399 - protein, 15 aa, Artificial Sequence
  Description of Artificial Sequence: Synthetic peptide
WYQQKPGKVPKLLIY

SEQ ID NO: 5400 - protein, 15 aa, Artificial Sequence
  Description of Artificial Sequence: Synthetic peptide
WYLQKPGQSPQLLIY

SEQ ID NO: 5401 - protein, 15 aa, Artificial Sequence
  Description of Artificial Sequence: Synthetic peptide
WYLQKPGQSPQLLIY

SEQ ID NO: 5402 - protein, 15 aa, Artificial Sequence
  Description of Artificial Sequence: Synthetic peptide
WYLQKPGQSPQLLIY

SEQ ID NO: 5403 - protein, 15 aa, Artificial Sequence
  Description of Artificial Sequence: Synthetic peptide
WFQQKPGQAPRALIY

SEQ ID NO: 5404 - protein, 15 aa, Artificial Sequence
  Description of Artificial Sequence: Synthetic peptide
WVQQKPGQAPRGLIG

SEQ ID NO: 5405 - protein, 15 aa, Artificial Sequence
  Description of Artificial Sequence: Synthetic peptide
WVQQKPGQAPRGLIG

SEQ ID NO: 5406 - protein, 15 aa, Artificial Sequence
  Description of Artificial Sequence: Synthetic peptide
WVQQKPGQAPRGLIG

SEQ ID NO: 5407 - protein, 15 aa, Artificial Sequence
  Description of Artificial Sequence: Synthetic peptide
WVQQKPGQAPRGLIG

SEQ ID NO: 5408 - protein, 15 aa, Artificial Sequence
  Description of Artificial Sequence: Synthetic peptide
WVQQKPGQAPRGLIG

SEQ ID NO: 5409 - protein, 15 aa, Artificial Sequence
  Description of Artificial Sequence: Synthetic peptide
WVQQKPGQAPRGLIG

SEQ ID NO: 5410 - protein, 15 aa, Artificial Sequence
  Description of Artificial Sequence: Synthetic peptide
WVQQKPGQAPRGLIG

SEQ ID NO: 5411 - protein, 15 aa, Artificial Sequence
  Description of Artificial Sequence: Synthetic peptide
WVQQKPGQAPRGLIG

SEQ ID NO: 5412 - protein, 15 aa, Artificial Sequence
  Description of Artificial Sequence: Synthetic peptide
WVQQKPGQAPRGLIG

SEQ ID NO: 5413 - protein, 15 aa, Artificial Sequence
  Description of Artificial Sequence: Synthetic peptide
WVQQKPGQAPRGLIG

SEQ ID NO: 5414 - protein, 15 aa, Artificial Sequence
  Description of Artificial Sequence: Synthetic peptide
WVQQKPGQAPRGLIG

SEQ ID NO: 5415 - protein, 15 aa, Artificial Sequence
  Description of Artificial Sequence: Synthetic peptide
WVQQKPGQAPRGLIG

SEQ ID NO: 5416 - protein, 15 aa, Artificial Sequence
  Description of Artificial Sequence: Synthetic peptide
WVQQKPGQAPRGLIG

SEQ ID NO: 5417 - protein, 15 aa, Artificial Sequence
  Description of Artificial Sequence: Synthetic peptide
WVQQKPGQAPRGLIG

SEQ ID NO: 5418 - protein, 15 aa, Artificial Sequence
  Description of Artificial Sequence: Synthetic peptide
WVQQKPGQAPRGLIG

SEQ ID NO: 5419 - protein, 15 aa, Artificial Sequence
  Description of Artificial Sequence: Synthetic peptide
WVQQKPGQAPRGLIG

SEQ ID NO: 5420 - protein, 15 aa, Artificial Sequence
  Description of Artificial Sequence: Synthetic peptide
WVQQKPGQAPRGLIG

SEQ ID NO: 5421 - protein, 15 aa, Artificial Sequence
  Description of Artificial Sequence: Synthetic peptide
WVQQKPGQAPRGLIG

SEQ ID NO: 5422 - protein, 15 aa, Artificial Sequence
  Description of Artificial Sequence: Synthetic peptide
WVQQKPGQAPRGLIG

SEQ ID NO: 5423 - protein, 15 aa, Artificial Sequence
  Description of Artificial Sequence: Synthetic peptide
WVQQKPGQAPRGLIG

SEQ ID NO: 5424 - protein, 15 aa, Artificial Sequence
  Description of Artificial Sequence: Synthetic peptide
WVQQKPGQAPRGLIG

SEQ ID NO: 5425 - protein, 15 aa, Artificial Sequence
  Description of Artificial Sequence: Synthetic peptide
WVQQKPGQAPRGLIG

SEQ ID NO: 5426 - protein, 15 aa, Artificial Sequence
  Description of Artificial Sequence: Synthetic peptide
WVQQKPGQAPRGLIG

SEQ ID NO: 5427 - protein, 15 aa, Artificial Sequence
  Description of Artificial Sequence: Synthetic peptide
WVQQKPGQAPRGLIG

SEQ ID NO: 5428 - protein, 14 aa, Artificial Sequence
  Description of Artificial Sequence: Synthetic peptide
WVRQAPGKGLEWVS

SEQ ID NO: 5429 - protein, 14 aa, Artificial Sequence
  Description of Artificial Sequence: Synthetic peptide
WVRQAPGKCLEWVS

SEQ ID NO: 5430 - protein, 14 aa, Artificial Sequence
  Description of Artificial Sequence: Synthetic peptide
WVRQAPGKGLEWVS

SEQ ID NO: 5431 - protein, 14 aa, Artificial Sequence
  Description of Artificial Sequence: Synthetic peptide
WVRQASGKGLEWVG

SEQ ID NO: 5432 - protein, 14 aa, Artificial Sequence
  Description of Artificial Sequence: Synthetic peptide
WVRQAPGKGLEWVA

SEQ ID NO: 5433 - protein, 14 aa, Artificial Sequence
  Description of Artificial Sequence: Synthetic peptide
WVRQAPGKGLEWVA

SEQ ID NO: 5434 - protein, 14 aa, Artificial Sequence
  Description of Artificial Sequence: Synthetic peptide
WVRQAPGKGLEWVA

SEQ ID NO: 5435 - protein, 14 aa, Artificial Sequence
  Description of Artificial Sequence: Synthetic peptide
WVRQAPGKGLEWVA

SEQ ID NO: 5436 - protein, 14 aa, Artificial Sequence
  Description of Artificial Sequence: Synthetic peptide
WVRQAPGKGLEWVA

SEQ ID NO: 5437 - protein, 14 aa, Artificial Sequence
  Description of Artificial Sequence: Synthetic peptide
WVRQAPGKGLEWVA

SEQ ID NO: 5438 - protein, 14 aa, Artificial Sequence
  Description of Artificial Sequence: Synthetic peptide
WVRQAPGKGLEWVA

SEQ ID NO: 5439 - protein, 14 aa, Artificial Sequence
  Description of Artificial Sequence: Synthetic peptide
WVRQAPGKGLEWVA

SEQ ID NO: 5440 - protein, 14 aa, Artificial Sequence
  Description of Artificial Sequence: Synthetic peptide
WVRQAPGKGLEWVA

SEQ ID NO: 5441 - protein, 14 aa, Artificial Sequence
  Description of Artificial Sequence: Synthetic peptide
WVRQAPGKGLEWVA

SEQ ID NO: 5442 - protein, 14 aa, Artificial Sequence
  Description of Artificial Sequence: Synthetic peptide
WVRQAPGKGLEWVA

SEQ ID NO: 5443 - protein, 14 aa, Artificial Sequence
  Description of Artificial Sequence: Synthetic peptide
WVRQAPGKGLEWVA

SEQ ID NO: 5444 - protein, 14 aa, Artificial Sequence
  Description of Artificial Sequence: Synthetic peptide
WVRQAPGKGLEWVA

SEQ ID NO: 5445 - protein, 14 aa, Artificial Sequence
  Description of Artificial Sequence: Synthetic peptide
WVRQAPGKGLEWVA

SEQ ID NO: 5446 - protein, 14 aa, Artificial Sequence
  Description of Artificial Sequence: Synthetic peptide
WVRQAPGKGLEWVA

SEQ ID NO: 5447 - protein, 14 aa, Artificial Sequence
  Description of Artificial Sequence: Synthetic peptide
WVRQAPGKGLEWVA

SEQ ID NO: 5448 - protein, 14 aa, Artificial Sequence
  Description of Artificial Sequence: Synthetic peptide
WVRQAPGKGLEWVA

SEQ ID NO: 5449 - protein, 14 aa, Artificial Sequence
  Description of Artificial Sequence: Synthetic peptide
WVRQAPGKGLEWVA

SEQ ID NO: 5450 - protein, 14 aa, Artificial Sequence
  Description of Artificial Sequence: Synthetic peptide
WVRQAPGKGLEWVA

SEQ ID NO: 5451 - protein, 14 aa, Artificial Sequence
  Description of Artificial Sequence: Synthetic peptide
WVRQAPGKGLEWVA

SEQ ID NO: 5452 - protein, 14 aa, Artificial Sequence
  Description of Artificial Sequence: Synthetic peptide
WVRQAPGKGLEWVA

SEQ ID NO: 5453 - protein, 14 aa, Artificial Sequence
  Description of Artificial Sequence: Synthetic peptide
WVRQAPGKGLEWVA

SEQ ID NO: 5454 - protein, 14 aa, Artificial Sequence
  Description of Artificial Sequence: Synthetic peptide
WVRQAPGKGLEWVA

SEQ ID NO: 5455 - protein, 14 aa, Artificial Sequence
  Description of Artificial Sequence: Synthetic peptide
WVRQAPGKGLEWVA

SEQ ID NO: 5456 - protein, 14 aa, Artificial Sequence
  Description of Artificial Sequence: Synthetic peptide
WVRQAPGKGLEWVS

SEQ ID NO: 5457 - protein, 14 aa, Artificial Sequence
  Description of Artificial Sequence: Synthetic peptide
WVRQAPGKCLEWVS

SEQ ID NO: 5458 - protein, 14 aa, Artificial Sequence
  Description of Artificial Sequence: Synthetic peptide
WVRQAPGKGLEWVS

SEQ ID NO: 5459 - protein, 14 aa, Artificial Sequence
  Description of Artificial Sequence: Synthetic peptide
WVRQAPGKCLEWVS

SEQ ID NO: 5460 - protein, 14 aa, Artificial Sequence
  Description of Artificial Sequence: Synthetic peptide
WVRQAPGKGLEWVS

SEQ ID NO: 5461 - protein, 14 aa, Artificial Sequence
  Description of Artificial Sequence: Synthetic peptide
WVRQAPGQGLEWMG

SEQ ID NO: 5462 - protein, 14 aa, Artificial Sequence
  Description of Artificial Sequence: Synthetic peptide
WVKQRPGKCLEWIG

SEQ ID NO: 5463 - protein, 14 aa, Artificial Sequence
  Description of Artificial Sequence: Synthetic peptide
WVKQRPGKGLEWIG

SEQ ID NO: 5464 - protein, 14 aa, Artificial Sequence
  Description of Artificial Sequence: Synthetic peptide
WVRQAPGQGLEWMG

SEQ ID NO: 5465 - protein, 14 aa, Artificial Sequence
  Description of Artificial Sequence: Synthetic peptide
WVKQRPGECLEWIG

SEQ ID NO: 5466 - protein, 14 aa, Artificial Sequence
  Description of Artificial Sequence: Synthetic peptide
WVKQRPGEGLEWIG

SEQ ID NO: 5467 - protein, 14 aa, Artificial Sequence
  Description of Artificial Sequence: Synthetic peptide
WVRQAPGQGLEWMG

SEQ ID NO: 5468 - protein, 14 aa, Artificial Sequence
  Description of Artificial Sequence: Synthetic peptide
WVKQRPGKCLEWIG

SEQ ID NO: 5469 - protein, 14 aa, Artificial Sequence
  Description of Artificial Sequence: Synthetic peptide
WVKQRPGKGLEWIG

SEQ ID NO: 5470 - protein, 14 aa, Artificial Sequence
  Description of Artificial Sequence: Synthetic peptide
WVRQATGQGLEWMG

SEQ ID NO: 5471 - protein, 14 aa, Artificial Sequence
  Description of Artificial Sequence: Synthetic peptide
WVRQATGQCLEWMG

SEQ ID NO: 5472 - protein, 14 aa, Artificial Sequence
  Description of Artificial Sequence: Synthetic peptide
WVRQATGQGLEWMG

SEQ ID NO: 5473 - protein, 14 aa, Artificial Sequence
  Description of Artificial Sequence: Synthetic peptide
WVRQAPGKGLEWVA

SEQ ID NO: 5474 - protein, 14 aa, Artificial Sequence
  Description of Artificial Sequence: Synthetic peptide
WVRQAPGKCLEWVA

SEQ ID NO: 5475 - protein, 14 aa, Artificial Sequence
  Description of Artificial Sequence: Synthetic peptide
WVRQAPGKGLEWVA

SEQ ID NO: 5476 - protein, 14 aa, Artificial Sequence
  Description of Artificial Sequence: Synthetic peptide
WIRQSPSRGLEWLG

SEQ ID NO: 5477 - protein, 14 aa, Artificial Sequence
  Description of Artificial Sequence: Synthetic peptide
WIRQSPSRCLEWLG

SEQ ID NO: 5478 - protein, 14 aa, Artificial Sequence
  Description of Artificial Sequence: Synthetic peptide
WIRQSPSRGLEWLG

SEQ ID NO: 5479 - protein, 14 aa, Artificial Sequence
  Description of Artificial Sequence: Synthetic peptide
WIRQPPGKGLEWIG

SEQ ID NO: 5480 - protein, 14 aa, Artificial Sequence
  Description of Artificial Sequence: Synthetic peptide
WIRQPPGKCLEWIG

SEQ ID NO: 5481 - protein, 14 aa, Artificial Sequence
  Description of Artificial Sequence: Synthetic peptide
WIRQPPGKGLEWIG

SEQ ID NO: 5482 - protein, 14 aa, Artificial Sequence
  Description of Artificial Sequence: Synthetic peptide
WVRQAPGQGLEWMG

SEQ ID NO: 5483 - protein, 14 aa, Artificial Sequence
  Description of Artificial Sequence: Synthetic peptide
WVRQAPGQCLEWMG

SEQ ID NO: 5484 - protein, 14 aa, Artificial Sequence
  Description of Artificial Sequence: Synthetic peptide
WVRQAPGQGLEWMG

SEQ ID NO: 5485 - protein, 14 aa, Artificial Sequence
  Description of Artificial Sequence: Synthetic peptide
WIRQHPGKGLEWIG

SEQ ID NO: 5486 - protein, 14 aa, Artificial Sequence
  Description of Artificial Sequence: Synthetic peptide
WIRQHPGKCLEWIG

SEQ ID NO: 5487 - protein, 14 aa, Artificial Sequence
  Description of Artificial Sequence: Synthetic peptide
WIRQHPGKGLEWIG

SEQ ID NO: 5488 - protein, 7 aa, Artificial Sequence
  Description of Artificial Sequence: Synthetic peptide
GASSRAT

SEQ ID NO: 5489 - protein, 7 aa, Artificial Sequence
  Description of Artificial Sequence: Synthetic peptide
GASSRAT

SEQ ID NO: 5490 - protein, 7 aa, Artificial Sequence
  Description of Artificial Sequence: Synthetic peptide
GASSRAT

SEQ ID NO: 5491 - protein, 7 aa, Artificial Sequence
  Description of Artificial Sequence: Synthetic peptide
GASSRAT

SEQ ID NO: 5492 - protein, 7 aa, Artificial Sequence
  Description of Artificial Sequence: Synthetic peptide
AASTLQS

SEQ ID NO: 5493 - protein, 7 aa, Artificial Sequence
  Description of Artificial Sequence: Synthetic peptide
AASTLQS

SEQ ID NO: 5494 - protein, 7 aa, Artificial Sequence
  Description of Artificial Sequence: Synthetic peptide
AASTLQS

SEQ ID NO: 5495 - protein, 7 aa, Artificial Sequence
  Description of Artificial Sequence: Synthetic peptide
WASTRES

SEQ ID NO: 5496 - protein, 7 aa, Artificial Sequence
  Description of Artificial Sequence: Synthetic peptide
WASTRES

SEQ ID NO: 5497 - protein, 7 aa, Artificial Sequence
  Description of Artificial Sequence: Synthetic peptide
WASTRES

SEQ ID NO: 5498 - protein, 7 aa, Artificial Sequence
  Description of Artificial Sequence: Synthetic peptide
YASQSFS

SEQ ID NO: 5499 - protein, 7 aa, Artificial Sequence
  Description of Artificial Sequence: Synthetic peptide
DTSKLAP

SEQ ID NO: 5500 - protein, 7 aa, Artificial Sequence
  Description of Artificial Sequence: Synthetic peptide
DTSKLAP

SEQ ID NO: 5501 - protein, 7 aa, Artificial Sequence
  Description of Artificial Sequence: Synthetic peptide
AASSLQS

SEQ ID NO: 5502 - protein, 7 aa, Artificial Sequence
  Description of Artificial Sequence: Synthetic peptide
NAKTLAG

SEQ ID NO: 5503 - protein, 7 aa, Artificial Sequence
  Description of Artificial Sequence: Synthetic peptide
NAKTLAG

SEQ ID NO: 5504 - protein, 7 aa, Artificial Sequence
  Description of Artificial Sequence: Synthetic peptide
LGSNRAS

SEQ ID NO: 5505 - protein, 7 aa, Artificial Sequence
  Description of Artificial Sequence: Synthetic peptide
LGSNRAS

SEQ ID NO: 5506 - protein, 7 aa, Artificial Sequence
  Description of Artificial Sequence: Synthetic peptide
LGSNRAS

SEQ ID NO: 5507 - protein, 7 aa, Artificial Sequence
  Description of Artificial Sequence: Synthetic peptide
GASSRAT

SEQ ID NO: 5508 - protein, 7 aa, Artificial Sequence
  Description of Artificial Sequence: Synthetic peptide
GASSRAT

SEQ ID NO: 5509 - protein, 7 aa, Artificial Sequence
  Description of Artificial Sequence: Synthetic peptide
LGSNRAS

SEQ ID NO: 5510 - protein, 7 aa, Artificial Sequence
  Description of Artificial Sequence: Synthetic peptide
LGSNRAS

SEQ ID NO: 5511 - protein, 7 aa, Artificial Sequence
  Description of Artificial Sequence: Synthetic peptide
LGSNRAS

SEQ ID NO: 5512 - protein, 7 aa, Artificial Sequence
  Description of Artificial Sequence: Synthetic peptide
LGSNRAS

SEQ ID NO: 5513 - protein, 7 aa, Artificial Sequence
  Description of Artificial Sequence: Synthetic peptide
LGSNRAS

SEQ ID NO: 5514 - protein, 7 aa, Artificial Sequence
  Description of Artificial Sequence: Synthetic peptide
LGSNRAS

SEQ ID NO: 5515 - protein, 7 aa, Artificial Sequence
  Description of Artificial Sequence: Synthetic peptide
LGSNRAS

SEQ ID NO: 5516 - protein, 7 aa, Artificial Sequence
  Description of Artificial Sequence: Synthetic peptide
AASSLQS

SEQ ID NO: 5517 - protein, 7 aa, Artificial Sequence
  Description of Artificial Sequence: Synthetic peptide
AASSLQS

SEQ ID NO: 5518 - protein, 7 aa, Artificial Sequence
  Description of Artificial Sequence: Synthetic peptide
AASSLQS

SEQ ID NO: 5519 - protein, 7 aa, Artificial Sequence
  Description of Artificial Sequence: Synthetic peptide
AASSLQS

SEQ ID NO: 5520 - protein, 7 aa, Artificial Sequence
  Description of Artificial Sequence: Synthetic peptide
AASTLQS

SEQ ID NO: 5521 - protein, 7 aa, Artificial Sequence
  Description of Artificial Sequence: Synthetic peptide
AASTLQS

SEQ ID NO: 5522 - protein, 7 aa, Artificial Sequence
  Description of Artificial Sequence: Synthetic peptide
AASTLQS

SEQ ID NO: 5523 - protein, 7 aa, Artificial Sequence
  Description of Artificial Sequence: Synthetic peptide
TLSYRAS

SEQ ID NO: 5524 - protein, 7 aa, Artificial Sequence
  Description of Artificial Sequence: Synthetic peptide
LGSNRAS

SEQ ID NO: 5525 - protein, 7 aa, Artificial Sequence
  Description of Artificial Sequence: Synthetic peptide
LGSNRAS

SEQ ID NO: 5526 - protein, 7 aa, Artificial Sequence
  Description of Artificial Sequence: Synthetic peptide
STSNKHS

SEQ ID NO: 5527 - protein, 7 aa, Artificial Sequence
  Description of Artificial Sequence: Synthetic peptide
GTKFLAP

SEQ ID NO: 5528 - protein, 7 aa, Artificial Sequence
  Description of Artificial Sequence: Synthetic peptide
GTKFLAP

SEQ ID NO: 5529 - protein, 7 aa, Artificial Sequence
  Description of Artificial Sequence: Synthetic peptide
GTKFLAP

SEQ ID NO: 5530 - protein, 7 aa, Artificial Sequence
  Description of Artificial Sequence: Synthetic peptide
GTKFLAP

SEQ ID NO: 5531 - protein, 7 aa, Artificial Sequence
  Description of Artificial Sequence: Synthetic peptide
GTKFLAP

SEQ ID NO: 5532 - protein, 7 aa, Artificial Sequence
  Description of Artificial Sequence: Synthetic peptide
GTKFLAP

SEQ ID NO: 5533 - protein, 7 aa, Artificial Sequence
  Description of Artificial Sequence: Synthetic peptide
GTKFLAP

SEQ ID NO: 5534 - protein, 7 aa, Artificial Sequence
  Description of Artificial Sequence: Synthetic peptide
GTKFLAP

SEQ ID NO: 5535 - protein, 7 aa, Artificial Sequence
  Description of Artificial Sequence: Synthetic peptide
GTKFLAP

SEQ ID NO: 5536 - protein, 7 aa, Artificial Sequence
  Description of Artificial Sequence: Synthetic peptide
GTKFLAP

SEQ ID NO: 5537 - protein, 7 aa, Artificial Sequence
  Description of Artificial Sequence: Synthetic peptide
GTKFLAP

SEQ ID NO: 5538 - protein, 7 aa, Artificial Sequence
  Description of Artificial Sequence: Synthetic peptide
GTKFLAP

SEQ ID NO: 5539 - protein, 7 aa, Artificial Sequence
  Description of Artificial Sequence: Synthetic peptide
GTKFLAP

SEQ ID NO: 5540 - protein, 7 aa, Artificial Sequence
  Description of Artificial Sequence: Synthetic peptide
GTKFLAP

SEQ ID NO: 5541 - protein, 7 aa, Artificial Sequence
  Description of Artificial Sequence: Synthetic peptide
GTKFLAP

SEQ ID NO: 5542 - protein, 7 aa, Artificial Sequence
  Description of Artificial Sequence: Synthetic peptide
GTKFLAP

SEQ ID NO: 5543 - protein, 7 aa, Artificial Sequence
  Description of Artificial Sequence: Synthetic peptide
GTKFLAP

SEQ ID NO: 5544 - protein, 7 aa, Artificial Sequence
  Description of Artificial Sequence: Synthetic peptide
GTKFLAP

SEQ ID NO: 5545 - protein, 7 aa, Artificial Sequence
  Description of Artificial Sequence: Synthetic peptide
GTKFLAP

SEQ ID NO: 5546 - protein, 7 aa, Artificial Sequence
  Description of Artificial Sequence: Synthetic peptide
GTKFLAP

SEQ ID NO: 5547 - protein, 7 aa, Artificial Sequence
  Description of Artificial Sequence: Synthetic peptide
GTKFLAP

SEQ ID NO: 5548 - protein, 7 aa, Artificial Sequence
  Description of Artificial Sequence: Synthetic peptide
GTKFLAP

SEQ ID NO: 5549 - protein, 7 aa, Artificial Sequence
  Description of Artificial Sequence: Synthetic peptide
GTKFLAP

SEQ ID NO: 5550 - protein, 7 aa, Artificial Sequence
  Description of Artificial Sequence: Synthetic peptide
GTKFLAP

SEQ ID NO: 5551 - protein, 17 aa, Artificial Sequence
  Description of Artificial Sequence: Synthetic peptide
SISSSSSYIYYADSVKG

SEQ ID NO: 5552 - protein, 17 aa, Artificial Sequence
  Description of Artificial Sequence: Synthetic peptide
SISSSSSYIYYADSVKG

SEQ ID NO: 5553 - protein, 17 aa, Artificial Sequence
  Description of Artificial Sequence: Synthetic peptide
SISSSSSYIYYADSVKG

SEQ ID NO: 5554 - protein, 19 aa, Artificial Sequence
  Description of Artificial Sequence: Synthetic peptide
RIRSKANSYATAYAASVKG

SEQ ID NO: 5555 - protein, 19 aa, Artificial Sequence
  Description of Artificial Sequence: Synthetic peptide
RIRSKYNNYATYYADSVKD

SEQ ID NO: 5556 - protein, 19 aa, Artificial Sequence
  Description of Artificial Sequence: Synthetic peptide
RIRSKYNNYATYYADSVKD

SEQ ID NO: 5557 - protein, 19 aa, Artificial Sequence
  Description of Artificial Sequence: Synthetic peptide
RIRSKYNNYATYYADSVKD

SEQ ID NO: 5558 - protein, 19 aa, Artificial Sequence
  Description of Artificial Sequence: Synthetic peptide
RIRSKYNNYATYYADSVKD

SEQ ID NO: 5559 - protein, 19 aa, Artificial Sequence
  Description of Artificial Sequence: Synthetic peptide
RIRSKYNNYATYYADSVKD

SEQ ID NO: 5560 - protein, 19 aa, Artificial Sequence
  Description of Artificial Sequence: Synthetic peptide
RIRSKYNNYATYYADSVKD

SEQ ID NO: 5561 - protein, 19 aa, Artificial Sequence
  Description of Artificial Sequence: Synthetic peptide
RIRSKYNNYATYYADSVKD

SEQ ID NO: 5562 - protein, 19 aa, Artificial Sequence
  Description of Artificial Sequence: Synthetic peptide
RIRSKYNNYATYYADSVKD

SEQ ID NO: 5563 - protein, 19 aa, Artificial Sequence
  Description of Artificial Sequence: Synthetic peptide
RIRSKYNNYATYYADSVKD

SEQ ID NO: 5564 - protein, 19 aa, Artificial Sequence
  Description of Artificial Sequence: Synthetic peptide
RIRSKYNNYATYYADSVKD

SEQ ID NO: 5565 - protein, 19 aa, Artificial Sequence
  Description of Artificial Sequence: Synthetic peptide
RIRSKYNNYATYYADSVKD

SEQ ID NO: 5566 - protein, 19 aa, Artificial Sequence
  Description of Artificial Sequence: Synthetic peptide
RIRSKYNNYATYYADSVKD

SEQ ID NO: 5567 - protein, 19 aa, Artificial Sequence
  Description of Artificial Sequence: Synthetic peptide
RIRSKYNNYATYYADSVKD

SEQ ID NO: 5568 - protein, 19 aa, Artificial Sequence
  Description of Artificial Sequence: Synthetic peptide
RIRSKYNNYATYYADSVKD

SEQ ID NO: 5569 - protein, 19 aa, Artificial Sequence
  Description of Artificial Sequence: Synthetic peptide
RIRSKYNNYATYYADSVKD

SEQ ID NO: 5570 - protein, 19 aa, Artificial Sequence
  Description of Artificial Sequence: Synthetic peptide
RIRSKYNNYATYYADSVKD

SEQ ID NO: 5571 - protein, 19 aa, Artificial Sequence
  Description of Artificial Sequence: Synthetic peptide
RIRSKYNNYATYYADSVKD

SEQ ID NO: 5572 - protein, 19 aa, Artificial Sequence
  Description of Artificial Sequence: Synthetic peptide
RIRSKYNNYATYYADSVKD

SEQ ID NO: 5573 - protein, 19 aa, Artificial Sequence
  Description of Artificial Sequence: Synthetic peptide
RIRSKYNNYATYYADSVKD

SEQ ID NO: 5574 - protein, 19 aa, Artificial Sequence
  Description of Artificial Sequence: Synthetic peptide
RIRSKYNNYATYYADSVKD

SEQ ID NO: 5575 - protein, 19 aa, Artificial Sequence
  Description of Artificial Sequence: Synthetic peptide
RIRSKYNNYATYYADSVKD

SEQ ID NO: 5576 - protein, 19 aa, Artificial Sequence
  Description of Artificial Sequence: Synthetic peptide
RIRSKYNNYATYYADSVKD

SEQ ID NO: 5577 - protein, 19 aa, Artificial Sequence
  Description of Artificial Sequence: Synthetic peptide
RIRSKYNNYATYYADSVKD

SEQ ID NO: 5578 - protein, 19 aa, Artificial Sequence
  Description of Artificial Sequence: Synthetic peptide
RIRSKYNNYATYYADSVKD

SEQ ID NO: 5579 - protein, 17 aa, Artificial Sequence
  Description of Artificial Sequence: Synthetic peptide
AISGSGGSTYYADSVKG

SEQ ID NO: 5580 - protein, 17 aa, Artificial Sequence
  Description of Artificial Sequence: Synthetic peptide
AISGSGGSTYYADSVKG

SEQ ID NO: 5581 - protein, 17 aa, Artificial Sequence
  Description of Artificial Sequence: Synthetic peptide
AISGSGGSTYYADSVKG

SEQ ID NO: 5582 - protein, 17 aa, Artificial Sequence
  Description of Artificial Sequence: Synthetic peptide
AISGSGGSTYYADSVKG

SEQ ID NO: 5583 - protein, 17 aa, Artificial Sequence
  Description of Artificial Sequence: Synthetic peptide
AISGSGGSTYYADSVKG

SEQ ID NO: 5584 - protein, 17 aa, Artificial Sequence
  Description of Artificial Sequence: Synthetic peptide
GIIPIFGTANYAQKFQG

SEQ ID NO: 5585 - protein, 17 aa, Artificial Sequence
  Description of Artificial Sequence: Synthetic peptide
RIYPGDGDTNYNGKFKG

SEQ ID NO: 5586 - protein, 17 aa, Artificial Sequence
  Description of Artificial Sequence: Synthetic peptide
RIYPGDGDTNYNGKFKG

SEQ ID NO: 5587 - protein, 17 aa, Artificial Sequence
  Description of Artificial Sequence: Synthetic peptide
GIIPIFGTANYAQKFQG

SEQ ID NO: 5588 - protein, 17 aa, Artificial Sequence
  Description of Artificial Sequence: Synthetic peptide
RVWPGDGDTTYNEKFKG

SEQ ID NO: 5589 - protein, 17 aa, Artificial Sequence
  Description of Artificial Sequence: Synthetic peptide
RVWPGDGDTTYNEKFKG

SEQ ID NO: 5590 - protein, 17 aa, Artificial Sequence
  Description of Artificial Sequence: Synthetic peptide
GIIPIFGTANYAQKFQG

SEQ ID NO: 5591 - protein, 17 aa, Artificial Sequence
  Description of Artificial Sequence: Synthetic peptide
RIYPGDGDTNYNGKFKD

SEQ ID NO: 5592 - protein, 17 aa, Artificial Sequence
  Description of Artificial Sequence: Synthetic peptide
RIYPGDGDTNYNGKFKD

SEQ ID NO: 5593 - protein, 17 aa, Artificial Sequence
  Description of Artificial Sequence: Synthetic peptide
WMNPNSGNTGYAQKFQG

SEQ ID NO: 5594 - protein, 17 aa, Artificial Sequence
  Description of Artificial Sequence: Synthetic peptide
WMNPNSGNTGYAQKFQG

SEQ ID NO: 5595 - protein, 17 aa, Artificial Sequence
  Description of Artificial Sequence: Synthetic peptide
WMNPNSGNTGYAQKFQG

SEQ ID NO: 5596 - protein, 17 aa, Artificial Sequence
  Description of Artificial Sequence: Synthetic peptide
VISYDGSNKYYADSVKG

SEQ ID NO: 5597 - protein, 17 aa, Artificial Sequence
  Description of Artificial Sequence: Synthetic peptide
VISYDGGNKYYADSVKG

SEQ ID NO: 5598 - protein, 17 aa, Artificial Sequence
  Description of Artificial Sequence: Synthetic peptide
VISYDGGNKYYADSVKG

SEQ ID NO: 5599 - protein, 18 aa, Artificial Sequence
  Description of Artificial Sequence: Synthetic peptide
RTYYRSKWYNDYAVSVKS

SEQ ID NO: 5600 - protein, 18 aa, Artificial Sequence
  Description of Artificial Sequence: Synthetic peptide
RTYYRSKWYNDYAVSVKS

SEQ ID NO: 5601 - protein, 18 aa, Artificial Sequence
  Description of Artificial Sequence: Synthetic peptide
RTYYRSKWYNDYAVSVKS

SEQ ID NO: 5602 - protein, 16 aa, Artificial Sequence
  Description of Artificial Sequence: Synthetic peptide
EINHSGSTNYNPSLKS

SEQ ID NO: 5603 - protein, 16 aa, Artificial Sequence
  Description of Artificial Sequence: Synthetic peptide
EINHRGSTNYNPSLKS

SEQ ID NO: 5604 - protein, 16 aa, Artificial Sequence
  Description of Artificial Sequence: Synthetic peptide
EINHRGSTNYNPSLKS

SEQ ID NO: 5605 - protein, 17 aa, Artificial Sequence
  Description of Artificial Sequence: Synthetic peptide
WINPNSGGTNYAQKFQG

SEQ ID NO: 5606 - protein, 17 aa, Artificial Sequence
  Description of Artificial Sequence: Synthetic peptide
RINPNSGDTHYAQKFQG

SEQ ID NO: 5607 - protein, 17 aa, Artificial Sequence
  Description of Artificial Sequence: Synthetic peptide
RINPNSGDTHYAQKFQG

SEQ ID NO: 5608 - protein, 16 aa, Artificial Sequence
  Description of Artificial Sequence: Synthetic peptide
YIYYSGSTYYNPSLKS

SEQ ID NO: 5609 - protein, 16 aa, Artificial Sequence
  Description of Artificial Sequence: Synthetic peptide
YIYYSGSTYYNPSLKS

SEQ ID NO: 5610 - protein, 16 aa, Artificial Sequence
  Description of Artificial Sequence: Synthetic peptide
YIYYSGSTYYNPSLKS

SEQ ID NO: 5611 - protein, 32 aa, Artificial Sequence; identical to SEQ ID NO: 4211
  Description of Artificial Sequence: Synthetic polypeptide

SEQ ID NO: 5612 - protein, 32 aa, Artificial Sequence; identical to SEQ ID NO: 4211
  Description of Artificial Sequence: Synthetic polypeptide

SEQ ID NO: 5613 - protein, 32 aa, Artificial Sequence; identical to SEQ ID NO: 4211
  Description of Artificial Sequence: Synthetic polypeptide

SEQ ID NO: 5614 - protein, 32 aa, Artificial Sequence; identical to SEQ ID NO: 4211
  Description of Artificial Sequence: Synthetic polypeptide

SEQ ID NO: 5615 - protein, 32 aa, Artificial Sequence; identical to SEQ ID NO: 1369
  Description of Artificial Sequence: Synthetic polypeptide

SEQ ID NO: 5616 - protein, 32 aa, Artificial Sequence; identical to SEQ ID NO: 1346
  Description of Artificial Sequence: Synthetic polypeptide

SEQ ID NO: 5617 - protein, 32 aa, Artificial Sequence; identical to SEQ ID NO: 1346
  Description of Artificial Sequence: Synthetic polypeptide

SEQ ID NO: 5618 - protein, 32 aa, Artificial Sequence; identical to SEQ ID NO: 1367
  Description of Artificial Sequence: Synthetic polypeptide

SEQ ID NO: 5619 - protein, 32 aa, Artificial Sequence; identical to SEQ ID NO: 4214
  Description of Artificial Sequence: Synthetic polypeptide

SEQ ID NO: 5620 - protein, 32 aa, Artificial Sequence; identical to SEQ ID NO: 4214
  Description of Artificial Sequence: Synthetic polypeptide

SEQ ID NO: 5621 - protein, 32 aa, Artificial Sequence; identical to SEQ ID NO: 4215
  Description of Artificial Sequence: Synthetic polypeptide

SEQ ID NO: 5622 - protein, 32 aa, Artificial Sequence; identical to SEQ ID NO: 4216
  Description of Artificial Sequence: Synthetic polypeptide

SEQ ID NO: 5623 - protein, 32 aa, Artificial Sequence; identical to SEQ ID NO: 4216
  Description of Artificial Sequence: Synthetic polypeptide

SEQ ID NO: 5624 - protein, 32 aa, Artificial Sequence; identical to SEQ ID NO: 1346
  Description of Artificial Sequence: Synthetic polypeptide

SEQ ID NO: 5625 - protein, 32 aa, Artificial Sequence; identical to SEQ ID NO: 4218
  Description of Artificial Sequence: Synthetic polypeptide

SEQ ID NO: 5626 - protein, 32 aa, Artificial Sequence; identical to SEQ ID NO: 4218
  Description of Artificial Sequence: Synthetic polypeptide

SEQ ID NO: 5627 - protein, 32 aa, Artificial Sequence; identical to SEQ ID NO: 1372
  Description of Artificial Sequence: Synthetic polypeptide

SEQ ID NO: 5628 - protein, 32 aa, Artificial Sequence; identical to SEQ ID NO: 4220
  Description of Artificial Sequence: Synthetic polypeptide

SEQ ID NO: 5629 - protein, 32 aa, Artificial Sequence; identical to SEQ ID NO: 4220
  Description of Artificial Sequence: Synthetic polypeptide

SEQ ID NO: 5630 - protein, 32 aa, Artificial Sequence; identical to SEQ ID NO: 4211
  Description of Artificial Sequence: Synthetic polypeptide

SEQ ID NO: 5631 - protein, 32 aa, Artificial Sequence; identical to SEQ ID NO: 4211
  Description of Artificial Sequence: Synthetic polypeptide

SEQ ID NO: 5632 - protein, 32 aa, Artificial Sequence; identical to SEQ ID NO: 1372
  Description of Artificial Sequence: Synthetic polypeptide

SEQ ID NO: 5633 - protein, 32 aa, Artificial Sequence; identical to SEQ ID NO: 1372
  Description of Artificial Sequence: Synthetic polypeptide

SEQ ID NO: 5634 - protein, 32 aa, Artificial Sequence; identical to SEQ ID NO: 4220
  Description of Artificial Sequence: Synthetic polypeptide

SEQ ID NO: 5635 - protein, 32 aa, Artificial Sequence; identical to SEQ ID NO: 1372
  Description of Artificial Sequence: Synthetic polypeptide

SEQ ID NO: 5636 - protein, 32 aa, Artificial Sequence; identical to SEQ ID NO: 1372
  Description of Artificial Sequence: Synthetic polypeptide

SEQ ID NO: 5637 - protein, 32 aa, Artificial Sequence; identical to SEQ ID NO: 1372
  Description of Artificial Sequence: Synthetic polypeptide

SEQ ID NO: 5638 - protein, 32 aa, Artificial Sequence; identical to SEQ ID NO: 4220
  Description of Artificial Sequence: Synthetic polypeptide

SEQ ID NO: 5639 - protein, 32 aa, Artificial Sequence; identical to SEQ ID NO: 1346
  Description of Artificial Sequence: Synthetic polypeptide

SEQ ID NO: 5640 - protein, 32 aa, Artificial Sequence; identical to SEQ ID NO: 1346
  Description of Artificial Sequence: Synthetic polypeptide

SEQ ID NO: 5641 - protein, 32 aa, Artificial Sequence; identical to SEQ ID NO: 1346
  Description of Artificial Sequence: Synthetic polypeptide

SEQ ID NO: 5642 - protein, 32 aa, Artificial Sequence; identical to SEQ ID NO: 1346
  Description of Artificial Sequence: Synthetic polypeptide

SEQ ID NO: 5643 - protein, 32 aa, Artificial Sequence; identical to SEQ ID NO: 1369
  Description of Artificial Sequence: Synthetic polypeptide

SEQ ID NO: 5644 - protein, 32 aa, Artificial Sequence; identical to SEQ ID NO: 1369
  Description of Artificial Sequence: Synthetic polypeptide

SEQ ID NO: 5645 - protein, 32 aa, Artificial Sequence; identical to SEQ ID NO: 1369
  Description of Artificial Sequence: Synthetic polypeptide

SEQ ID NO: 5646 - protein, 32 aa, Artificial Sequence; identical to SEQ ID NO: 1372
  Description of Artificial Sequence: Synthetic polypeptide

SEQ ID NO: 5647 - protein, 32 aa, Artificial Sequence; identical to SEQ ID NO: 1372
  Description of Artificial Sequence: Synthetic polypeptide

SEQ ID NO: 5648 - protein, 32 aa, Artificial Sequence; identical to SEQ ID NO: 1372
  Description of Artificial Sequence: Synthetic polypeptide

SEQ ID NO: 5649 - protein, 32 aa, Artificial Sequence; identical to SEQ ID NO: 1385
  Description of Artificial Sequence: Synthetic polypeptide

SEQ ID NO: 5650 - protein, 32 aa, Artificial Sequence; identical to SEQ ID NO: 1386
  Description of Artificial Sequence: Synthetic polypeptide

SEQ ID NO: 5651 - protein, 32 aa, Artificial Sequence; identical to SEQ ID NO: 1386
  Description of Artificial Sequence: Synthetic polypeptide

SEQ ID NO: 5652 - protein, 32 aa, Artificial Sequence; identical to SEQ ID NO: 1386
  Description of Artificial Sequence: Synthetic polypeptide

SEQ ID NO: 5653 - protein, 32 aa, Artificial Sequence; identical to SEQ ID NO: 1386
  Description of Artificial Sequence: Synthetic polypeptide

SEQ ID NO: 5654 - protein, 32 aa, Artificial Sequence; identical to SEQ ID NO: 1386
  Description of Artificial Sequence: Synthetic polypeptide

SEQ ID NO: 5655 - protein, 32 aa, Artificial Sequence; identical to SEQ ID NO: 1386
  Description of Artificial Sequence: Synthetic polypeptide

SEQ ID NO: 5656 - protein, 32 aa, Artificial Sequence; identical to SEQ ID NO: 1386
  Description of Artificial Sequence: Synthetic polypeptide

SEQ ID NO: 5657 - protein, 32 aa, Artificial Sequence; identical to SEQ ID NO: 1386
  Description of Artificial Sequence: Synthetic polypeptide

SEQ ID NO: 5658 - protein, 32 aa, Artificial Sequence; identical to SEQ ID NO: 1386
  Description of Artificial Sequence: Synthetic polypeptide

SEQ ID NO: 5659 - protein, 32 aa, Artificial Sequence; identical to SEQ ID NO: 1386
  Description of Artificial Sequence: Synthetic polypeptide

SEQ ID NO: 5660 - protein, 32 aa, Artificial Sequence; identical to SEQ ID NO: 1386
  Description of Artificial Sequence: Synthetic polypeptide

SEQ ID NO: 5661 - protein, 32 aa, Artificial Sequence; identical to SEQ ID NO: 1386
  Description of Artificial Sequence: Synthetic polypeptide

SEQ ID NO: 5662 - protein, 32 aa, Artificial Sequence; identical to SEQ ID NO: 1386
  Description of Artificial Sequence: Synthetic polypeptide

SEQ ID NO: 5663 - protein, 32 aa, Artificial Sequence; identical to SEQ ID NO: 1386
  Description of Artificial Sequence: Synthetic polypeptide

SEQ ID NO: 5664 - protein, 32 aa, Artificial Sequence; identical to SEQ ID NO: 1386
  Description of Artificial Sequence: Synthetic polypeptide

SEQ ID NO: 5665 - protein, 32 aa, Artificial Sequence; identical to SEQ ID NO: 1386
  Description of Artificial Sequence: Synthetic polypeptide

SEQ ID NO: 5666 - protein, 32 aa, Artificial Sequence; identical to SEQ ID NO: 1386
  Description of Artificial Sequence: Synthetic polypeptide

SEQ ID NO: 5667 - protein, 32 aa, Artificial Sequence; identical to SEQ ID NO: 1386
  Description of Artificial Sequence: Synthetic polypeptide

SEQ ID NO: 5668 - protein, 32 aa, Artificial Sequence; identical to SEQ ID NO: 1386
  Description of Artificial Sequence: Synthetic polypeptide

SEQ ID NO: 5669 - protein, 32 aa, Artificial Sequence; identical to SEQ ID NO: 1386
  Description of Artificial Sequence: Synthetic polypeptide

SEQ ID NO: 5670 - protein, 32 aa, Artificial Sequence; identical to SEQ ID NO: 1386
  Description of Artificial Sequence: Synthetic polypeptide

SEQ ID NO: 5671 - protein, 32 aa, Artificial Sequence; identical to SEQ ID NO: 1386
  Description of Artificial Sequence: Synthetic polypeptide

SEQ ID NO: 5672 - protein, 32 aa, Artificial Sequence; identical to SEQ ID NO: 1386
  Description of Artificial Sequence: Synthetic polypeptide

SEQ ID NO: 5673 - protein, 32 aa, Artificial Sequence; identical to SEQ ID NO: 1386
  Description of Artificial Sequence: Synthetic polypeptide

SEQ ID NO: 5674 - protein, 32 aa, Artificial Sequence; identical to SEQ ID NO: 1504
  Description of Artificial Sequence: Synthetic polypeptide

SEQ ID NO: 5675 - protein, 32 aa, Artificial Sequence; identical to SEQ ID NO: 4237
  Description of Artificial Sequence: Synthetic polypeptide

SEQ ID NO: 5676 - protein, 32 aa, Artificial Sequence; identical to SEQ ID NO: 4237
  Description of Artificial Sequence: Synthetic polypeptide

SEQ ID NO: 5677 - protein, 32 aa, Artificial Sequence; identical to SEQ ID NO: 1441
  Description of Artificial Sequence: Synthetic polypeptide

SEQ ID NO: 5678 - protein, 32 aa, Artificial Sequence; identical to SEQ ID NO: 1442
  Description of Artificial Sequence: Synthetic polypeptide

SEQ ID NO: 5679 - protein, 32 aa, Artificial Sequence; identical to SEQ ID NO: 1442
  Description of Artificial Sequence: Synthetic polypeptide

SEQ ID NO: 5680 - protein, 32 aa, Artificial Sequence; identical to SEQ ID NO: 1442
  Description of Artificial Sequence: Synthetic polypeptide

SEQ ID NO: 5681 - protein, 32 aa, Artificial Sequence; identical to SEQ ID NO: 1442
  Description of Artificial Sequence: Synthetic polypeptide

SEQ ID NO: 5682 - protein, 32 aa, Artificial Sequence; identical to SEQ ID NO: 1442
  Description of Artificial Sequence: Synthetic polypeptide

SEQ ID NO: 5683 - protein, 32 aa, Artificial Sequence; identical to SEQ ID NO: 1442
  Description of Artificial Sequence: Synthetic polypeptide

SEQ ID NO: 5684 - protein, 32 aa, Artificial Sequence; identical to SEQ ID NO: 1442
  Description of Artificial Sequence: Synthetic polypeptide

SEQ ID NO: 5685 - protein, 32 aa, Artificial Sequence; identical to SEQ ID NO: 1442
  Description of Artificial Sequence: Synthetic polypeptide

SEQ ID NO: 5686 - protein, 32 aa, Artificial Sequence; identical to SEQ ID NO: 1442
  Description of Artificial Sequence: Synthetic polypeptide

SEQ ID NO: 5687 - protein, 32 aa, Artificial Sequence; identical to SEQ ID NO: 1442
  Description of Artificial Sequence: Synthetic polypeptide

SEQ ID NO: 5688 - protein, 32 aa, Artificial Sequence; identical to SEQ ID NO: 1442
  Description of Artificial Sequence: Synthetic polypeptide

SEQ ID NO: 5689 - protein, 32 aa, Artificial Sequence; identical to SEQ ID NO: 1442
  Description of Artificial Sequence: Synthetic polypeptide

SEQ ID NO: 5690 - protein, 32 aa, Artificial Sequence; identical to SEQ ID NO: 1442
  Description of Artificial Sequence: Synthetic polypeptide

SEQ ID NO: 5691 - protein, 32 aa, Artificial Sequence; identical to SEQ ID NO: 1442
  Description of Artificial Sequence: Synthetic polypeptide

SEQ ID NO: 5692 - protein, 32 aa, Artificial Sequence; identical to SEQ ID NO: 1442
  Description of Artificial Sequence: Synthetic polypeptide

SEQ ID NO: 5693 - protein, 32 aa, Artificial Sequence; identical to SEQ ID NO: 1442
  Description of Artificial Sequence: Synthetic polypeptide

SEQ ID NO: 5694 - protein, 32 aa, Artificial Sequence; identical to SEQ ID NO: 1442
  Description of Artificial Sequence: Synthetic polypeptide

SEQ ID NO: 5695 - protein, 32 aa, Artificial Sequence; identical to SEQ ID NO: 1442
  Description of Artificial Sequence: Synthetic polypeptide

SEQ ID NO: 5696 - protein, 32 aa, Artificial Sequence; identical to SEQ ID NO: 1442
  Description of Artificial Sequence: Synthetic polypeptide

SEQ ID NO: 5697 - protein, 32 aa, Artificial Sequence; identical to SEQ ID NO: 1442
  Description of Artificial Sequence: Synthetic polypeptide

SEQ ID NO: 5698 - protein, 32 aa, Artificial Sequence; identical to SEQ ID NO: 1442
  Description of Artificial Sequence: Synthetic polypeptide

SEQ ID NO: 5699 - protein, 32 aa, Artificial Sequence; identical to SEQ ID NO: 1442
  Description of Artificial Sequence: Synthetic polypeptide

SEQ ID NO: 5700 - protein, 32 aa, Artificial Sequence; identical to SEQ ID NO: 1442
  Description of Artificial Sequence: Synthetic polypeptide

SEQ ID NO: 5701 - protein, 32 aa, Artificial Sequence; identical to SEQ ID NO: 1442
  Description of Artificial Sequence: Synthetic polypeptide

SEQ ID NO: 5702 - protein, 32 aa, Artificial Sequence; identical to SEQ ID NO: 1427
  Description of Artificial Sequence: Synthetic polypeptide

SEQ ID NO: 5703 - protein, 32 aa, Artificial Sequence
  Description of Artificial Sequence: Synthetic polypeptide
RFTISRDNSKNTLYLQMNSLRAEDTAEYYCAK

SEQ ID NO: 5704 - protein, 32 aa, Artificial Sequence; identical to SEQ ID NO: 5703
  Description of Artificial Sequence: Synthetic polypeptide

SEQ ID NO: 5705 - protein, 32 aa, Artificial Sequence; identical to SEQ ID NO: 5703
  Description of Artificial Sequence: Synthetic polypeptide

SEQ ID NO: 5706 - protein, 32 aa, Artificial Sequence; identical to SEQ ID NO: 5703
  Description of Artificial Sequence: Synthetic polypeptide

SEQ ID NO: 5707 - protein, 32 aa, Artificial Sequence; identical to SEQ ID NO: 4249
  Description of Artificial Sequence: Synthetic polypeptide

SEQ ID NO: 5708 - protein, 32 aa, Artificial Sequence; identical to SEQ ID NO: 4250
  Description of Artificial Sequence: Synthetic polypeptide

SEQ ID NO: 5709 - protein, 32 aa, Artificial Sequence; identical to SEQ ID NO: 4250
  Description of Artificial Sequence: Synthetic polypeptide

SEQ ID NO: 5710 - protein, 32 aa, Artificial Sequence; identical to SEQ ID NO: 4249
  Description of Artificial Sequence: Synthetic polypeptide

SEQ ID NO: 5711 - protein, 32 aa, Artificial Sequence; identical to SEQ ID NO: 4252
  Description of Artificial Sequence: Synthetic polypeptide

SEQ ID NO: 5712 - protein, 32 aa, Artificial Sequence; identical to SEQ ID NO: 4252
  Description of Artificial Sequence: Synthetic polypeptide

SEQ ID NO: 5713 - protein, 32 aa, Artificial Sequence; identical to SEQ ID NO: 4249
  Description of Artificial Sequence: Synthetic polypeptide

SEQ ID NO: 5714 - protein, 32 aa, Artificial Sequence; identical to SEQ ID NO: 4254
  Description of Artificial Sequence: Synthetic polypeptide

SEQ ID NO: 5715 - protein, 32 aa, Artificial Sequence; identical to SEQ ID NO: 4254
  Description of Artificial Sequence: Synthetic polypeptide

SEQ ID NO: 5716 - protein, 32 aa, Artificial Sequence; identical to SEQ ID NO: 4255
  Description of Artificial Sequence: Synthetic polypeptide

SEQ ID NO: 5717 - protein, 32 aa, Artificial Sequence; identical to SEQ ID NO: 4255
  Description of Artificial Sequence: Synthetic polypeptide

SEQ ID NO: 5718 - protein, 32 aa, Artificial Sequence; identical to SEQ ID NO: 4255
  Description of Artificial Sequence: Synthetic polypeptide

SEQ ID NO: 5719 - protein, 32 aa, Artificial Sequence; identical to SEQ ID NO: 1501
  Description of Artificial Sequence: Synthetic polypeptide

SEQ ID NO: 5720 - protein, 32 aa, Artificial Sequence; identical to SEQ ID NO: 1501
  Description of Artificial Sequence: Synthetic polypeptide

SEQ ID NO: 5721 - protein, 32 aa, Artificial Sequence; identical to SEQ ID NO: 1501
  Description of Artificial Sequence: Synthetic polypeptide

SEQ ID NO: 5722 - protein, 32 aa, Artificial Sequence
  Description of Artificial Sequence: Synthetic polypeptide
RITINPDTSKNQFSLQLNSVTPEDTAVYYCAR

SEQ ID NO: 5723 - protein, 32 aa, Artificial Sequence
  Description of Artificial Sequence: Synthetic polypeptide
RITINPDTSKNQFSLQLNSVTPEDTAVYYCVR

SEQ ID NO: 5724 - protein, 32 aa, Artificial Sequence; identical to SEQ ID NO: 5723
  Description of Artificial Sequence: Synthetic polypeptide

SEQ ID NO: 5725 - protein, 32 aa, Artificial Sequence; identical to SEQ ID NO: 1499
  Description of Artificial Sequence: Synthetic polypeptide

SEQ ID NO: 5726 - protein, 32 aa, Artificial Sequence
  Description of Artificial Sequence: Synthetic polypeptide
RVTISVDASKNQFSLKLSSVTAADTAVYYCAR

SEQ ID NO: 5727 - protein, 32 aa, Artificial Sequence; identical to SEQ ID NO: 5726
  Description of Artificial Sequence: Synthetic polypeptide

SEQ ID NO: 5728 - protein, 32 aa, Artificial Sequence
  Description of Artificial Sequence: Synthetic polypeptide
RVTMTRDTSISTAYMELSRLRSDDTAVYYCAR

SEQ ID NO: 5729 - protein, 32 aa, Artificial Sequence; identical to SEQ ID NO: 5728
  Description of Artificial Sequence: Synthetic polypeptide

SEQ ID NO: 5730 - protein, 32 aa, Artificial Sequence; identical to SEQ ID NO: 5728
  Description of Artificial Sequence: Synthetic polypeptide

SEQ ID NO: 5731 - protein, 32 aa, Artificial Sequence; identical to SEQ ID NO: 1499
  Description of Artificial Sequence: Synthetic polypeptide

SEQ ID NO: 5732 - protein, 32 aa, Artificial Sequence; identical to SEQ ID NO: 1499
  Description of Artificial Sequence: Synthetic polypeptide

SEQ ID NO: 5733 - protein, 32 aa, Artificial Sequence; identical to SEQ ID NO: 1499
  Description of Artificial Sequence: Synthetic polypeptide

SEQ ID NO: 5734 - protein, 9 aa, Artificial Sequence
  Description of Artificial Sequence: Synthetic peptide
QQYGSSPLT

SEQ ID NO: 5735 - protein, 9 aa, Artificial Sequence
  Description of Artificial Sequence: Synthetic peptide
QQYANSPLT

SEQ ID NO: 5736 - protein, 9 aa, Artificial Sequence
  Description of Artificial Sequence: Synthetic peptide
QQYANSPLT

SEQ ID NO: 5737 - protein, 9 aa, Artificial Sequence
  Description of Artificial Sequence: Synthetic peptide
QQYGSSPLT

SEQ ID NO: 5738 - protein, 9 aa, Artificial Sequence
  Description of Artificial Sequence: Synthetic peptide
QKYNSAPWT

SEQ ID NO: 5739 - protein, 9 aa, Artificial Sequence
  Description of Artificial Sequence: Synthetic peptide
QQSYSTPPT

SEQ ID NO: 5740 - protein, 9 aa, Artificial Sequence
  Description of Artificial Sequence: Synthetic peptide
QQSYSTPPT

SEQ ID NO: 5741 - protein, 9 aa, Artificial Sequence
  Description of Artificial Sequence: Synthetic peptide
QQYYSTPYT

SEQ ID NO: 5742 - protein, 9 aa, Artificial Sequence
  Description of Artificial Sequence: Synthetic peptide
QQYYSYPYT

SEQ ID NO: 5743 - protein, 9 aa, Artificial Sequence
  Description of Artificial Sequence: Synthetic peptide
QQYYSYPYT

SEQ ID NO: 5744 - protein, 9 aa, Artificial Sequence
  Description of Artificial Sequence: Synthetic peptide
HQSSSLPYT

SEQ ID NO: 5745 - protein, 9 aa, Artificial Sequence
  Description of Artificial Sequence: Synthetic peptide
HQWSSYPPT

SEQ ID NO: 5746 - protein, 9 aa, Artificial Sequence
  Description of Artificial Sequence: Synthetic peptide
HQWSSYPPT

SEQ ID NO: 5747 - protein, 9 aa, Artificial Sequence
  Description of Artificial Sequence: Synthetic peptide
LQDYNYPYT

SEQ ID NO: 5748 - protein, 9 aa, Artificial Sequence
  Description of Artificial Sequence: Synthetic peptide
QHHYGTPLT

SEQ ID NO: 5749 - protein, 9 aa, Artificial Sequence
  Description of Artificial Sequence: Synthetic peptide
QHHYGTPLT

SEQ ID NO: 5750 - protein, 9 aa, Artificial Sequence
  Description of Artificial Sequence: Synthetic peptide
MQALQTPIT

SEQ ID NO: 5751 - protein, 9 aa, Artificial Sequence
  Description of Artificial Sequence: Synthetic peptide
MQALQTPPT

SEQ ID NO: 5752 - protein, 9 aa, Artificial Sequence
  Description of Artificial Sequence: Synthetic peptide
MQALQTPPT

SEQ ID NO: 5753 - protein, 9 aa, Artificial Sequence
  Description of Artificial Sequence: Synthetic peptide
QQYGSSPYT

SEQ ID NO: 5754 - protein, 9 aa, Artificial Sequence
  Description of Artificial Sequence: Synthetic peptide
QQYGSSPLT

SEQ ID NO: 5755 - protein, 9 aa, Artificial Sequence
  Description of Artificial Sequence: Synthetic peptide
MQALQTPFT

SEQ ID NO: 5756 - protein, 9 aa, Artificial Sequence
  Description of Artificial Sequence: Synthetic peptide
MQALQTPLT

SEQ ID NO: 5757 - protein, 9 aa, Artificial Sequence
  Description of Artificial Sequence: Synthetic peptide
MQALQTPFT

SEQ ID NO: 5758 - protein, 9 aa, Artificial Sequence
  Description of Artificial Sequence: Synthetic peptide
MQALQTPLT

SEQ ID NO: 5759 - protein, 9 aa, Artificial Sequence
  Description of Artificial Sequence: Synthetic peptide
MQALQTPLT

SEQ ID NO: 5760 - protein, 9 aa, Artificial Sequence
  Description of Artificial Sequence: Synthetic peptide
MQALQTPWT

SEQ ID NO: 5761 - protein, 9 aa, Artificial Sequence
  Description of Artificial Sequence: Synthetic peptide
MQALQTPFT

SEQ ID NO: 5762 - protein, 9 aa, Artificial Sequence
  Description of Artificial Sequence: Synthetic peptide
QQANSFPFT

SEQ ID NO: 5763 - protein, 9 aa, Artificial Sequence
  Description of Artificial Sequence: Synthetic peptide
QQSYRTPPT

SEQ ID NO: 5764 - protein, 9 aa, Artificial Sequence
  Description of Artificial Sequence: Synthetic peptide
QQANSFPWT

SEQ ID NO: 5765 - protein, 9 aa, Artificial Sequence
  Description of Artificial Sequence: Synthetic peptide
QQSYRTPPT

SEQ ID NO: 5766 - protein, 9 aa, Artificial Sequence
  Description of Artificial Sequence: Synthetic peptide
QKYNSAPYT

SEQ ID NO: 5767 - protein, 9 aa, Artificial Sequence
  Description of Artificial Sequence: Synthetic peptide
QKYNSAPWT

SEQ ID NO: 5768 - protein, 9 aa, Artificial Sequence
  Description of Artificial Sequence: Synthetic peptide
QKYNSAPWT

SEQ ID NO: 5769 - protein, 9 aa, Artificial Sequence
  Description of Artificial Sequence: Synthetic peptide
MQRIEFPIT

SEQ ID NO: 5770 - protein, 9 aa, Artificial Sequence
  Description of Artificial Sequence: Synthetic peptide
MQALQTPIT

SEQ ID NO: 5771 - protein, 9 aa, Artificial Sequence
  Description of Artificial Sequence: Synthetic peptide
MQALQTPIT

SEQ ID NO: 5772 - protein, 10 aa, Artificial Sequence
  Description of Artificial Sequence: Synthetic peptide
LLYYGGAQWV

SEQ ID NO: 5773 - protein, 9 aa, Artificial Sequence
  Description of Artificial Sequence: Synthetic peptide
VLWYSNRWV

SEQ ID NO: 5774 - protein, 9 aa, Artificial Sequence
  Description of Artificial Sequence: Synthetic peptide
VLWYSNRWV

SEQ ID NO: 5775 - protein, 9 aa, Artificial Sequence
  Description of Artificial Sequence: Synthetic peptide
VLWYSNRWV

SEQ ID NO: 5776 - protein, 9 aa, Artificial Sequence
  Description of Artificial Sequence: Synthetic peptide
VLWYSNRWV

SEQ ID NO: 5777 - protein, 9 aa, Artificial Sequence
  Description of Artificial Sequence: Synthetic peptide
VLWYSNRWV

SEQ ID NO: 5778 - protein, 9 aa, Artificial Sequence
  Description of Artificial Sequence: Synthetic peptide
VLWYSNRWV

SEQ ID NO: 5779 - protein, 9 aa, Artificial Sequence
  Description of Artificial Sequence: Synthetic peptide
VLWYSNRWV

SEQ ID NO: 5780 - protein, 9 aa, Artificial Sequence
  Description of Artificial Sequence: Synthetic peptide
VLWYSNRWV

SEQ ID NO: 5781 - protein, 9 aa, Artificial Sequence
  Description of Artificial Sequence: Synthetic peptide
VLWYSNRWV

SEQ ID NO: 5782 - protein, 9 aa, Artificial Sequence
  Description of Artificial Sequence: Synthetic peptide
VLWYSNRWV

SEQ ID NO: 5783 - protein, 9 aa, Artificial Sequence
  Description of Artificial Sequence: Synthetic peptide
VLWYSNRWV

SEQ ID NO: 5784 - protein, 9 aa, Artificial Sequence
  Description of Artificial Sequence: Synthetic peptide
VLWYSNRWV

SEQ ID NO: 5785 - protein, 9 aa, Artificial Sequence
  Description of Artificial Sequence: Synthetic peptide
VLWYSNRWV

SEQ ID NO: 5786 - protein, 9 aa, Artificial Sequence
  Description of Artificial Sequence: Synthetic peptide
VLWYSNRWV

SEQ ID NO: 5787 - protein, 9 aa, Artificial Sequence
  Description of Artificial Sequence: Synthetic peptide
VLWYSNRWV

SEQ ID NO: 5788 - protein, 9 aa, Artificial Sequence
  Description of Artificial Sequence: Synthetic peptide
VLWYSNRWV

SEQ ID NO: 5789 - protein, 9 aa, Artificial Sequence
  Description of Artificial Sequence: Synthetic peptide
VLWYSNRWV

SEQ ID NO: 5790 - protein, 9 aa, Artificial Sequence
  Description of Artificial Sequence: Synthetic peptide
VLWYSNRWV

SEQ ID NO: 5791 - protein, 9 aa, Artificial Sequence
  Description of Artificial Sequence: Synthetic peptide
VLWYSNRWV

SEQ ID NO: 5792 - protein, 9 aa, Artificial Sequence
  Description of Artificial Sequence: Synthetic peptide
VLWYSNRWV

SEQ ID NO: 5793 - protein, 9 aa, Artificial Sequence
  Description of Artificial Sequence: Synthetic peptide
VLWYSNRWV

SEQ ID NO: 5794 - protein, 9 aa, Artificial Sequence
  Description of Artificial Sequence: Synthetic peptide
VLWYSNRWV

SEQ ID NO: 5795 - protein, 9 aa, Artificial Sequence
  Description of Artificial Sequence: Synthetic peptide
VLWYSNRWV

SEQ ID NO: 5796 - protein, 9 aa, Artificial Sequence
  Description of Artificial Sequence: Synthetic peptide
VLWYSNRWV

SEQ ID NO: 5797 - protein, 15 aa, Artificial Sequence
  Description of Artificial Sequence: Synthetic peptide
DIVVVVAATAEYFQH

SEQ ID NO: 5798 - protein, 11 aa, Artificial Sequence
  Description of Artificial Sequence: Synthetic peptide
DRIAVATYFDN

SEQ ID NO: 5799 - protein, 11 aa, Artificial Sequence
  Description of Artificial Sequence: Synthetic peptide
DRIAVATYFDN

SEQ ID NO: 5800 - protein, 13 aa, Artificial Sequence
  Description of Artificial Sequence: Synthetic peptide
ITIFGVVIIYFDY

SEQ ID NO: 5801 - protein, 14 aa, Artificial Sequence
  Description of Artificial Sequence: Synthetic peptide
HGNFGNSYISYWAY

SEQ ID NO: 5802 - protein, 14 aa, Artificial Sequence
  Description of Artificial Sequence: Synthetic peptide
HGNFGNSYISYWAY

SEQ ID NO: 5803 - protein, 14 aa, Artificial Sequence
  Description of Artificial Sequence: Synthetic peptide
HGNFGNSYISYWAY

SEQ ID NO: 5804 - protein, 14 aa, Artificial Sequence
  Description of Artificial Sequence: Synthetic peptide
HGNFGNSYISYWAY

SEQ ID NO: 5805 - protein, 14 aa, Artificial Sequence
  Description of Artificial Sequence: Synthetic peptide
HGNFGNSYISYWAY

SEQ ID NO: 5806 - protein, 14 aa, Artificial Sequence
  Description of Artificial Sequence: Synthetic peptide
HGNFGNSYISYWAY

SEQ ID NO: 5807 - protein, 14 aa, Artificial Sequence
  Description of Artificial Sequence: Synthetic peptide
HGNFGNSYISYWAY

SEQ ID NO: 5808 - protein, 14 aa, Artificial Sequence
  Description of Artificial Sequence: Synthetic peptide
HGNFGNSYISYWAY

SEQ ID NO: 5809 - protein, 14 aa, Artificial Sequence
  Description of Artificial Sequence: Synthetic peptide
HGNFGNSYISYWAY

SEQ ID NO: 5810 - protein, 14 aa, Artificial Sequence
  Description of Artificial Sequence: Synthetic peptide
HGNFGNSYISYWAY

SEQ ID NO: 5811 - protein, 14 aa, Artificial Sequence
  Description of Artificial Sequence: Synthetic peptide
HGNFGNSYISYWAY

SEQ ID NO: 5812 - protein, 14 aa, Artificial Sequence
  Description of Artificial Sequence: Synthetic peptide
HGNFGNSYISYWAY

SEQ ID NO: 5813 - protein, 14 aa, Artificial Sequence
  Description of Artificial Sequence: Synthetic peptide
HGNFGNSYISYWAY

SEQ ID NO: 5814 - protein, 14 aa, Artificial Sequence
  Description of Artificial Sequence: Synthetic peptide
HGNFGNSYISYWAY

SEQ ID NO: 5815 - protein, 14 aa, Artificial Sequence
  Description of Artificial Sequence: Synthetic peptide
HGNFGNSYISYWAY

SEQ ID NO: 5816 - protein, 14 aa, Artificial Sequence
  Description of Artificial Sequence: Synthetic peptide
HGNFGNSYISYWAY

SEQ ID NO: 5817 - protein, 14 aa, Artificial Sequence
  Description of Artificial Sequence: Synthetic peptide
HGNFGNSYISYWAY

SEQ ID NO: 5818 - protein, 14 aa, Artificial Sequence
  Description of Artificial Sequence: Synthetic peptide
HGNFGNSYISYWAY

SEQ ID NO: 5819 - protein, 14 aa, Artificial Sequence
  Description of Artificial Sequence: Synthetic peptide
HGNFGNSYISYWAY

SEQ ID NO: 5820 - protein, 14 aa, Artificial Sequence
  Description of Artificial Sequence: Synthetic peptide
HGNFGNSYISYWAY

SEQ ID NO: 5821 - protein, 14 aa, Artificial Sequence
  Description of Artificial Sequence: Synthetic peptide
HGNFGNSYISYWAY

SEQ ID NO: 5822 - protein, 14 aa, Artificial Sequence
  Description of Artificial Sequence: Synthetic peptide
HGNFGNSYISYWAY

SEQ ID NO: 5823 - protein, 14 aa, Artificial Sequence
  Description of Artificial Sequence: Synthetic peptide
HGNFGNSYISYWAY

SEQ ID NO: 5824 - protein, 14 aa, Artificial Sequence
  Description of Artificial Sequence: Synthetic peptide
HGNFGNSYISYWAY

SEQ ID NO: 5825 - protein, 14 aa, Artificial Sequence
  Description of Artificial Sequence: Synthetic peptide
GTTGTYYYYYGMDV

SEQ ID NO: 5826 - protein, 12 aa, Artificial Sequence
  Description of Artificial Sequence: Synthetic peptide
MVTPDYYYDMDV

SEQ ID NO: 5827 - protein, 12 aa, Artificial Sequence
  Description of Artificial Sequence: Synthetic peptide
MVTPDYYYDMDV

SEQ ID NO: 5828 - protein, 12 aa, Artificial Sequence
  Description of Artificial Sequence: Synthetic peptide
MVTPDYYYDMDV

SEQ ID NO: 5829 - protein, 12 aa, Artificial Sequence
  Description of Artificial Sequence: Synthetic peptide
MVTPDYYYDMDV

SEQ ID NO: 5830 - protein, 13 aa, Artificial Sequence
  Description of Artificial Sequence: Synthetic peptide
DIVVVVAATYFDY

SEQ ID NO: 5831 - protein, 10 aa, Artificial Sequence
  Description of Artificial Sequence: Synthetic peptide
DGVFYAPLAY

SEQ ID NO: 5832 - protein, 10 aa, Artificial Sequence
  Description of Artificial Sequence: Synthetic peptide
DGVFYAPLAY

SEQ ID NO: 5833 - protein, 10 aa, Artificial Sequence
  Description of Artificial Sequence: Synthetic peptide
GYSYGYYFDY

SEQ ID NO: 5834 - protein, 13 aa, Artificial Sequence
  Description of Artificial Sequence: Synthetic peptide
GNYFGSSEAYFDY

SEQ ID NO: 5835 - protein, 13 aa, Artificial Sequence
  Description of Artificial Sequence: Synthetic peptide
GNYFGSSEAYFDY

SEQ ID NO: 5836 - protein, 10 aa, Artificial Sequence
  Description of Artificial Sequence: Synthetic peptide
VQLERDAFDI

SEQ ID NO: 5837 - protein, 11 aa, Artificial Sequence
  Description of Artificial Sequence: Synthetic peptide
RQLNHVFAMDY

SEQ ID NO: 5838 - protein, 11 aa, Artificial Sequence
  Description of Artificial Sequence: Synthetic peptide
RQLNHVFAMDY

SEQ ID NO: 5839 - protein, 15 aa, Artificial Sequence
  Description of Artificial Sequence: Synthetic peptide
GYSYGYYYYYYGMDV

SEQ ID NO: 5840 - protein, 14 aa, Artificial Sequence
  Description of Artificial Sequence: Synthetic peptide
GGGYSNGYDYGMDV

SEQ ID NO: 5841 - protein, 14 aa, Artificial Sequence
  Description of Artificial Sequence: Synthetic peptide
GGGYSNGYDYGMDV

SEQ ID NO: 5842 - protein, 14 aa, Artificial Sequence
  Description of Artificial Sequence: Synthetic peptide
VQLERYYYYYGMDV

SEQ ID NO: 5843 - protein, 12 aa, Artificial Sequence
  Description of Artificial Sequence: Synthetic peptide
EQWPNYYYGMDV

SEQ ID NO: 5844 - protein, 12 aa, Artificial Sequence
  Description of Artificial Sequence: Synthetic peptide
EQWPNYYYGMDV

SEQ ID NO: 5845 - protein, 9 aa, Artificial Sequence
  Description of Artificial Sequence: Synthetic peptide
VLLWFGELL

SEQ ID NO: 5846 - protein, 9 aa, Artificial Sequence
  Description of Artificial Sequence: Synthetic peptide
YYYYYGMDV

SEQ ID NO: 5847 - protein, 16 aa, Artificial Sequence
  Description of Artificial Sequence: Synthetic peptide
EILWFGKLNYYYGMDV

SEQ ID NO: 5848 - protein, 16 aa, Artificial Sequence
  Description of Artificial Sequence: Synthetic peptide
EILWFGKLNYYYGMDV

SEQ ID NO: 5849 - protein, 15 aa, Artificial Sequence
  Description of Artificial Sequence: Synthetic peptide
GYSYGYYYYYYGMDV

SEQ ID NO: 5850 - protein, 14 aa, Artificial Sequence
  Description of Artificial Sequence: Synthetic peptide
GGGYSDGYDYGMDV

SEQ ID NO: 5851 - protein, 14 aa, Artificial Sequence
  Description of Artificial Sequence: Synthetic peptide
GGGYSDGYDYGMDV

SEQ ID NO: 5852 - protein, 6 aa, Artificial Sequence
  Description of Artificial Sequence: Synthetic peptide
LGYFDY

SEQ ID NO: 5853 - protein, 9 aa, Artificial Sequence
  Description of Artificial Sequence: Synthetic peptide
GLGISFFDY

SEQ ID NO: 5854 - protein, 9 aa, Artificial Sequence
  Description of Artificial Sequence: Synthetic peptide
GLGISFFDY

SEQ ID NO: 5855 - protein, 9 aa, Artificial Sequence
  Description of Artificial Sequence: Synthetic peptide
VLLWFGELL

SEQ ID NO: 5856 - protein, 9 aa, Artificial Sequence
  Description of Artificial Sequence: Synthetic peptide
YYYYYGMDV

SEQ ID NO: 5857 - protein, 16 aa, Artificial Sequence
  Description of Artificial Sequence: Synthetic peptide
DKLWFGKLNYYYGMDV

SEQ ID NO: 5858 - protein, 16 aa, Artificial Sequence
  Description of Artificial Sequence: Synthetic peptide
DKLWFGKLNYYYGMDV

SEQ ID NO: 5859 - protein, 10 aa, Artificial Sequence
  Description of Artificial Sequence: Synthetic peptide
FGGGTKVEIK

SEQ ID NO: 5860 - protein, 10 aa, Artificial Sequence
  Description of Artificial Sequence: Synthetic peptide
FGCGTKVEIK

SEQ ID NO: 5861 - protein, 10 aa, Artificial Sequence
  Description of Artificial Sequence: Synthetic peptide
FGGGTKVEIK

SEQ ID NO: 5862 - protein, 10 aa, Artificial Sequence
  Description of Artificial Sequence: Synthetic peptide
FGGGTKLEIK

SEQ ID NO: 5863 - protein, 10 aa, Artificial Sequence
  Description of Artificial Sequence: Synthetic peptide
FGQGTKVEIK

SEQ ID NO: 5864 - protein, 10 aa, Artificial Sequence
  Description of Artificial Sequence: Synthetic peptide
FGCGTKVEIK

SEQ ID NO: 5865 - protein, 10 aa, Artificial Sequence
  Description of Artificial Sequence: Synthetic peptide
FGQGTKVEIK

SEQ ID NO: 5866 - protein, 10 aa, Artificial Sequence
  Description of Artificial Sequence: Synthetic peptide
FGQGTKLEIK

SEQ ID NO: 5867 - protein, 10 aa, Artificial Sequence
  Description of Artificial Sequence: Synthetic peptide
FGCGTKLELK

SEQ ID NO: 5868 - protein, 10 aa, Artificial Sequence
  Description of Artificial Sequence: Synthetic peptide
FGGGTKLELK

SEQ ID NO: 5869 - protein, 10 aa, Artificial Sequence
  Description of Artificial Sequence: Synthetic peptide
FGQGTKLEIK

SEQ ID NO: 5870 - protein, 10 aa, Artificial Sequence
  Description of Artificial Sequence: Synthetic peptide
FGCGTKLEIK

SEQ ID NO: 5871 - protein, 10 aa, Artificial Sequence
  Description of Artificial Sequence: Synthetic peptide
FGSGTKLEIK

SEQ ID NO: 5872 - protein, 10 aa, Artificial Sequence
  Description of Artificial Sequence: Synthetic peptide
FGQGTKLEIK

SEQ ID NO: 5873 - protein, 10 aa, Artificial Sequence
  Description of Artificial Sequence: Synthetic peptide
FGCGTKLELK

SEQ ID NO: 5874 - protein, 10 aa, Artificial Sequence
  Description of Artificial Sequence: Synthetic peptide
FGAGTKLELK

SEQ ID NO: 5875 - protein, 10 aa, Artificial Sequence
  Description of Artificial Sequence: Synthetic peptide
FGQGTRLEIK

SEQ ID NO: 5876 - protein, 10 aa, Artificial Sequence
  Description of Artificial Sequence: Synthetic peptide
FGCGTRLEIK

SEQ ID NO: 5877 - protein, 10 aa, Artificial Sequence
  Description of Artificial Sequence: Synthetic peptide
FGQGTRLEIK

SEQ ID NO: 5878 - protein, 10 aa, Artificial Sequence
  Description of Artificial Sequence: Synthetic peptide
FGQGTKLEIK

SEQ ID NO: 5879 - protein, 10 aa, Artificial Sequence
  Description of Artificial Sequence: Synthetic peptide
FGCGTKLEIK

SEQ ID NO: 5880 - protein, 10 aa, Artificial Sequence
  Description of Artificial Sequence: Synthetic peptide
FGPGTKVDIK

SEQ ID NO: 5881 - protein, 10 aa, Artificial Sequence
  Description of Artificial Sequence: Synthetic peptide
FGCGTKVDIK

SEQ ID NO: 5882 - protein, 10 aa, Artificial Sequence
  Description of Artificial Sequence: Synthetic peptide
FGPGTKVEIK

SEQ ID NO: 5883 - protein, 10 aa, Artificial Sequence
  Description of Artificial Sequence: Synthetic peptide
FGGGTKVEIK

SEQ ID NO: 5884 - protein, 10 aa, Artificial Sequence
  Description of Artificial Sequence: Synthetic peptide
FGGGTKVDIK

SEQ ID NO: 5885 - protein, 10 aa, Artificial Sequence
  Description of Artificial Sequence: Synthetic peptide
FGQGTKVEIK

SEQ ID NO: 5886 - protein, 10 aa, Artificial Sequence
  Description of Artificial Sequence: Synthetic peptide
FGCGTKVEIK

SEQ ID NO: 5887 - protein, 10 aa, Artificial Sequence
  Description of Artificial Sequence: Synthetic peptide
FGPGTKVDIK

SEQ ID NO: 5888 - protein, 10 aa, Artificial Sequence
  Description of Artificial Sequence: Synthetic peptide
FGCGTKVDIK

SEQ ID NO: 5889 - protein, 10 aa, Artificial Sequence
  Description of Artificial Sequence: Synthetic peptide
FGQGTKVEIK

SEQ ID NO: 5890 - protein, 10 aa, Artificial Sequence
  Description of Artificial Sequence: Synthetic peptide
FGQGTKVDIK

SEQ ID NO: 5891 - protein, 10 aa, Artificial Sequence
  Description of Artificial Sequence: Synthetic peptide
FGQGTKLEIK

SEQ ID NO: 5892 - protein, 10 aa, Artificial Sequence
  Description of Artificial Sequence: Synthetic peptide
FGCGTKLEIK

SEQ ID NO: 5893 - protein, 10 aa, Artificial Sequence
  Description of Artificial Sequence: Synthetic peptide
FGQGTKLEIK

SEQ ID NO: 5894 - protein, 10 aa, Artificial Sequence
  Description of Artificial Sequence: Synthetic peptide
FGQGTRLEIK

SEQ ID NO: 5895 - protein, 10 aa, Artificial Sequence
  Description of Artificial Sequence: Synthetic peptide
FGCGTRLEIK

SEQ ID NO: 5896 - protein, 10 aa, Artificial Sequence
  Description of Artificial Sequence: Synthetic peptide
FGQGTRLEIK

SEQ ID NO: 5897 - protein, 10 aa, Artificial Sequence
  Description of Artificial Sequence: Synthetic peptide
FGGGTKLTVL

SEQ ID NO: 5898 - protein, 10 aa, Artificial Sequence
  Description of Artificial Sequence: Synthetic peptide
FGGGTKLTVL

SEQ ID NO: 5899 - protein, 10 aa, Artificial Sequence
  Description of Artificial Sequence: Synthetic peptide
FGGGTKLTVL

SEQ ID NO: 5900 - protein, 10 aa, Artificial Sequence
  Description of Artificial Sequence: Synthetic peptide
FGGGTKLTVL

SEQ ID NO: 5901 - protein, 10 aa, Artificial Sequence
  Description of Artificial Sequence: Synthetic peptide
FGGGTKLTVL

SEQ ID NO: 5902 - protein, 10 aa, Artificial Sequence
  Description of Artificial Sequence: Synthetic peptide
FGGGTKLTVL

SEQ ID NO: 5903 - protein, 10 aa, Artificial Sequence
  Description of Artificial Sequence: Synthetic peptide
FGGGTKLTVL

SEQ ID NO: 5904 - protein, 10 aa, Artificial Sequence
  Description of Artificial Sequence: Synthetic peptide
FGGGTKLTVL

SEQ ID NO: 5905 - protein, 10 aa, Artificial Sequence
  Description of Artificial Sequence: Synthetic peptide
FGGGTKLTVL

SEQ ID NO: 5906 - protein, 10 aa, Artificial Sequence
  Description of Artificial Sequence: Synthetic peptide
FGGGTKLTVL

SEQ ID NO: 5907 - protein, 10 aa, Artificial Sequence
  Description of Artificial Sequence: Synthetic peptide
FGGGTKLTVL

SEQ ID NO: 5908 - protein, 10 aa, Artificial Sequence
  Description of Artificial Sequence: Synthetic peptide
FGGGTKLTVL

SEQ ID NO: 5909 - protein, 10 aa, Artificial Sequence
  Description of Artificial Sequence: Synthetic peptide
FGGGTKLTVL

SEQ ID NO: 5910 - protein, 10 aa, Artificial Sequence
  Description of Artificial Sequence: Synthetic peptide
FGGGTKLTVL

SEQ ID NO: 5911 - protein, 10 aa, Artificial Sequence
  Description of Artificial Sequence: Synthetic peptide
FGGGTKLTVL

SEQ ID NO: 5912 - protein, 10 aa, Artificial Sequence
  Description of Artificial Sequence: Synthetic peptide
FGGGTKLTVL

SEQ ID NO: 5913 - protein, 10 aa, Artificial Sequence
  Description of Artificial Sequence: Synthetic peptide
FGGGTKLTVL

SEQ ID NO: 5914 - protein, 10 aa, Artificial Sequence
  Description of Artificial Sequence: Synthetic peptide
FGGGTKLTVL

SEQ ID NO: 5915 - protein, 10 aa, Artificial Sequence
  Description of Artificial Sequence: Synthetic peptide
FGGGTKLTVL

SEQ ID NO: 5916 - protein, 10 aa, Artificial Sequence
  Description of Artificial Sequence: Synthetic peptide
FGGGTKLTVL

SEQ ID NO: 5917 - protein, 10 aa, Artificial Sequence
  Description of Artificial Sequence: Synthetic peptide
FGGGTKLTVL

SEQ ID NO: 5918 - protein, 10 aa, Artificial Sequence
  Description of Artificial Sequence: Synthetic peptide
FGGGTKLTVL

SEQ ID NO: 5919 - protein, 10 aa, Artificial Sequence
  Description of Artificial Sequence: Synthetic peptide
FGGGTKLTVL

SEQ ID NO: 5920 - protein, 10 aa, Artificial Sequence
  Description of Artificial Sequence: Synthetic peptide
FGGGTKLTVL

SEQ ID NO: 5921 - protein, 10 aa, Artificial Sequence
  Description of Artificial Sequence: Synthetic peptide
FGGGTKLTVL

SEQ ID NO: 5922 - protein, 11 aa, Artificial Sequence
  Description of Artificial Sequence: Synthetic peptide
WGQGTLVTVSS

SEQ ID NO: 5923 - protein, 11 aa, Artificial Sequence
  Description of Artificial Sequence: Synthetic peptide
WGQGTLVTVSS

SEQ ID NO: 5924 - protein, 11 aa, Artificial Sequence
  Description of Artificial Sequence: Synthetic peptide
WGQGTLVTVSS

SEQ ID NO: 5925 - protein, 11 aa, Artificial Sequence
  Description of Artificial Sequence: Synthetic peptide
WGQGTLVTVSS

SEQ ID NO: 5926 - protein, 11 aa, Artificial Sequence
  Description of Artificial Sequence: Synthetic peptide
WGQGTLVTVSS

SEQ ID NO: 5927 - protein, 11 aa, Artificial Sequence
  Description of Artificial Sequence: Synthetic peptide
WGQGTLVTVSS

SEQ ID NO: 5928 - protein, 11 aa, Artificial Sequence
  Description of Artificial Sequence: Synthetic peptide
WGQGTLVTVSS

SEQ ID NO: 5929 - protein, 11 aa, Artificial Sequence
  Description of Artificial Sequence: Synthetic peptide
WGQGTLVTVSS

SEQ ID NO: 5930 - protein, 11 aa, Artificial Sequence
  Description of Artificial Sequence: Synthetic peptide
WGQGTLVTVSS

SEQ ID NO: 5931 - protein, 11 aa, Artificial Sequence
  Description of Artificial Sequence: Synthetic peptide
WGQGTLVTVSS

SEQ ID NO: 5932 - protein, 11 aa, Artificial Sequence
  Description of Artificial Sequence: Synthetic peptide
WGQGTLVTVSS

SEQ ID NO: 5933 - protein, 11 aa, Artificial Sequence
  Description of Artificial Sequence: Synthetic peptide
WGQGTLVTVSS

SEQ ID NO: 5934 - protein, 11 aa, Artificial Sequence
  Description of Artificial Sequence: Synthetic peptide
WGQGTLVTVSS

SEQ ID NO: 5935 - protein, 11 aa, Artificial Sequence
  Description of Artificial Sequence: Synthetic peptide
WGQGTLVTVSS

SEQ ID NO: 5936 - protein, 11 aa, Artificial Sequence
  Description of Artificial Sequence: Synthetic peptide
WGQGTLVTVSS

SEQ ID NO: 5937 - protein, 11 aa, Artificial Sequence
  Description of Artificial Sequence: Synthetic peptide
WGQGTLVTVSS

SEQ ID NO: 5938 - protein, 11 aa, Artificial Sequence
  Description of Artificial Sequence: Synthetic peptide
WGQGTLVTVSS

SEQ ID NO: 5939 - protein, 11 aa, Artificial Sequence
  Description of Artificial Sequence: Synthetic peptide
WGQGTLVTVSS

SEQ ID NO: 5940 - protein, 11 aa, Artificial Sequence
  Description of Artificial Sequence: Synthetic peptide
WGQGTLVTVSS

SEQ ID NO: 5941 - protein, 11 aa, Artificial Sequence
  Description of Artificial Sequence: Synthetic peptide
WGQGTLVTVSS

SEQ ID NO: 5942 - protein, 11 aa, Artificial Sequence
  Description of Artificial Sequence: Synthetic peptide
WGQGTLVTVSS

SEQ ID NO: 5943 - protein, 11 aa, Artificial Sequence
  Description of Artificial Sequence: Synthetic peptide
WGQGTLVTVSS

SEQ ID NO: 5944 - protein, 11 aa, Artificial Sequence
  Description of Artificial Sequence: Synthetic peptide
WGQGTLVTVSS

SEQ ID NO: 5945 - protein, 11 aa, Artificial Sequence
  Description of Artificial Sequence: Synthetic peptide
WGQGTLVTVSS

SEQ ID NO: 5946 - protein, 11 aa, Artificial Sequence
  Description of Artificial Sequence: Synthetic peptide
WGQGTLVTVSS

SEQ ID NO: 5947 - protein, 11 aa, Artificial Sequence
  Description of Artificial Sequence: Synthetic peptide
WGQGTLVTVSS

SEQ ID NO: 5948 - protein, 11 aa, Artificial Sequence
  Description of Artificial Sequence: Synthetic peptide
WGQGTLVTVSS

SEQ ID NO: 5949 - protein, 11 aa, Artificial Sequence
  Description of Artificial Sequence: Synthetic peptide
WGQGTLVTVSS

SEQ ID NO: 5950 - protein, 11 aa, Artificial Sequence
  Description of Artificial Sequence: Synthetic peptide
WGQGTTVTVSS

SEQ ID NO: 5951 - protein, 11 aa, Artificial Sequence
  Description of Artificial Sequence: Synthetic peptide
WGQGTTVTVSS

SEQ ID NO: 5952 - protein, 11 aa, Artificial Sequence
  Description of Artificial Sequence: Synthetic peptide
WGQGTTVTVSS

SEQ ID NO: 5953 - protein, 11 aa, Artificial Sequence
  Description of Artificial Sequence: Synthetic peptide
WGQGTTVTVSS

SEQ ID NO: 5954 - protein, 11 aa, Artificial Sequence
  Description of Artificial Sequence: Synthetic peptide
WGQGTTVTVSS

SEQ ID NO: 5955 - protein, 11 aa, Artificial Sequence
  Description of Artificial Sequence: Synthetic peptide
WGQGTLVTVSS

SEQ ID NO: 5956 - protein, 11 aa, Artificial Sequence
  Description of Artificial Sequence: Synthetic peptide
WGQGTLVTVSS

SEQ ID NO: 5957 - protein, 11 aa, Artificial Sequence
  Description of Artificial Sequence: Synthetic peptide
WGQGTLVTVSS

SEQ ID NO: 5958 - protein, 11 aa, Artificial Sequence
  Description of Artificial Sequence: Synthetic peptide
WGQGTLVTVSS

SEQ ID NO: 5959 - protein, 11 aa, Artificial Sequence
  Description of Artificial Sequence: Synthetic peptide
WGQGTRVTVSS

SEQ ID NO: 5960 - protein, 11 aa, Artificial Sequence
  Description of Artificial Sequence: Synthetic peptide
WGQGTRVTVSS

SEQ ID NO: 5961 - protein, 11 aa, Artificial Sequence
  Description of Artificial Sequence: Synthetic peptide
WGQGTMVTVSS

SEQ ID NO: 5962 - protein, 11 aa, Artificial Sequence
  Description of Artificial Sequence: Synthetic peptide
WGQGTSVTVSS

SEQ ID NO: 5963 - protein, 11 aa, Artificial Sequence
  Description of Artificial Sequence: Synthetic peptide
WGQGTSVTVSS

SEQ ID NO: 5964 - protein, 11 aa, Artificial Sequence
  Description of Artificial Sequence: Synthetic peptide
WGQGTTVTVSS

SEQ ID NO: 5965 - protein, 11 aa, Artificial Sequence
  Description of Artificial Sequence: Synthetic peptide
WGQGTTVTVSS

SEQ ID NO: 5966 - protein, 11 aa, Artificial Sequence
  Description of Artificial Sequence: Synthetic peptide
WGQGTTVTVSS

SEQ ID NO: 5967 - protein, 11 aa, Artificial Sequence
  Description of Artificial Sequence: Synthetic peptide
WGQGTTVTVSS

SEQ ID NO: 5968 - protein, 11 aa, Artificial Sequence
  Description of Artificial Sequence: Synthetic peptide
WGQGTTVTVSS

SEQ ID NO: 5969 - protein, 11 aa, Artificial Sequence
  Description of Artificial Sequence: Synthetic peptide
WGQGTTVTVSS

SEQ ID NO: 5970 - protein, 11 aa, Artificial Sequence
  Description of Artificial Sequence: Synthetic peptide
WGQGTTVTVSS

SEQ ID NO: 5971 - protein, 11 aa, Artificial Sequence
  Description of Artificial Sequence: Synthetic peptide
WGQGTTVTVSS

SEQ ID NO: 5972 - protein, 11 aa, Artificial Sequence
  Description of Artificial Sequence: Synthetic peptide
WGQGTTVTVSS

SEQ ID NO: 5973 - protein, 11 aa, Artificial Sequence
  Description of Artificial Sequence: Synthetic peptide
WGQGTTVTVSS

SEQ ID NO: 5974 - protein, 11 aa, Artificial Sequence
  Description of Artificial Sequence: Synthetic peptide
WGQGTTVTVSS

SEQ ID NO: 5975 - protein, 11 aa, Artificial Sequence
  Description of Artificial Sequence: Synthetic peptide
WGQGTTVTVSS

SEQ ID NO: 5976 - protein, 11 aa, Artificial Sequence
  Description of Artificial Sequence: Synthetic peptide
WGQGTLVTVSS

SEQ ID NO: 5977 - protein, 11 aa, Artificial Sequence
  Description of Artificial Sequence: Synthetic peptide
WGQGTLVTVSS

SEQ ID NO: 5978 - protein, 11 aa, Artificial Sequence
  Description of Artificial Sequence: Synthetic peptide
WGQGTLVTVSS

SEQ ID NO: 5979 - protein, 11 aa, Artificial Sequence
  Description of Artificial Sequence: Synthetic peptide
WGQGTTVTVSS

SEQ ID NO: 5980 - protein, 11 aa, Artificial Sequence
  Description of Artificial Sequence: Synthetic peptide
WGQGTTVTVSS

SEQ ID NO: 5981 - protein, 11 aa, Artificial Sequence
  Description of Artificial Sequence: Synthetic peptide
WGQGTTVTVSS

SEQ ID NO: 5982 - protein, 23 aa, Artificial Sequence
  Description of Artificial Sequence: Synthetic peptide
EIVLTQSPGTLSLSPGERATLSC

SEQ ID NO: 5983 - protein, 23 aa, Artificial Sequence
  Description of Artificial Sequence: Synthetic peptide
EIVLTQSPGTLSLSPGERATLSC

SEQ ID NO: 5984 - protein, 23 aa, Artificial Sequence
  Description of Artificial Sequence: Synthetic peptide
EIVLTQSPGTLSLSPGERATLSC

SEQ ID NO: 5985 - protein, 23 aa, Artificial Sequence
  Description of Artificial Sequence: Synthetic peptide
EIVLTQSPGTLSLSPGERATLSC

SEQ ID NO: 5986 - protein, 23 aa, Artificial Sequence
  Description of Artificial Sequence: Synthetic peptide
DIQMTQSPSSLSASVGDRVTITC

SEQ ID NO: 5987 - protein, 23 aa, Artificial Sequence
  Description of Artificial Sequence: Synthetic peptide
DIQMTQSPSSLSASVGDRVTITC

SEQ ID NO: 5988 - protein, 23 aa, Artificial Sequence
  Description of Artificial Sequence: Synthetic peptide
DIQMTQSPSSLSASVGDRVTITC

SEQ ID NO: 5989 - protein, 23 aa, Artificial Sequence
  Description of Artificial Sequence: Synthetic peptide
DIVMTQSPDSLAVSLGERATINC

SEQ ID NO: 5990 - protein, 23 aa, Artificial Sequence
  Description of Artificial Sequence: Synthetic peptide
ELVMTQSPSSLAVSVGEKITMSC

SEQ ID NO: 5991 - protein, 23 aa, Artificial Sequence
  Description of Artificial Sequence: Synthetic peptide
ELVMTQSPSSLAVSVGEKITMSC

SEQ ID NO: 5992 - protein, 23 aa, Artificial Sequence
  Description of Artificial Sequence: Synthetic peptide
EIVLTQSPDFQSVTPKEKVTITC

SEQ ID NO: 5993 - protein, 23 aa, Artificial Sequence
  Description of Artificial Sequence: Synthetic peptide
ELVLTQSPAIMSASPGQKVTITC

SEQ ID NO: 5994 - protein, 23 aa, Artificial Sequence
  Description of Artificial Sequence: Synthetic peptide
ELVLTQSPAIMSASPGQKVTITC

SEQ ID NO: 5995 - protein, 23 aa, Artificial Sequence
  Description of Artificial Sequence: Synthetic peptide
AIQMTQSPSSLSASVGDRVTITC

SEQ ID NO: 5996 - protein, 23 aa, Artificial Sequence
  Description of Artificial Sequence: Synthetic peptide
ELQMTQSPASLSASVGETVTITC

SEQ ID NO: 5997 - protein, 23 aa, Artificial Sequence
  Description of Artificial Sequence: Synthetic peptide
ELQMTQSPASLSASVGETVTITC

SEQ ID NO: 5998 - protein, 23 aa, Artificial Sequence
  Description of Artificial Sequence: Synthetic peptide
DIVMTQSPLSLPVTPGEPASISC

SEQ ID NO: 5999 - protein, 23 aa, Artificial Sequence
  Description of Artificial Sequence: Synthetic peptide
DIVMTQSPLSLPVSPGEPASISC

SEQ ID NO: 6000 - protein, 23 aa, Artificial Sequence
  Description of Artificial Sequence: Synthetic peptide
DIVMTQSPLSLPVSPGEPASISC

SEQ ID NO: 6001 - protein, 23 aa, Artificial Sequence
  Description of Artificial Sequence: Synthetic peptide
EIVLTQSPGTLSLSPGERATLSC

SEQ ID NO: 6002 - protein, 23 aa, Artificial Sequence
  Description of Artificial Sequence: Synthetic peptide
EIVLTQSPGTLSLSPGERATLSC

SEQ ID NO: 6003 - protein, 23 aa, Artificial Sequence
  Description of Artificial Sequence: Synthetic peptide
DIVMTQSPLSLPVTPGEPASISC

SEQ ID NO: 6004 - protein, 23 aa, Artificial Sequence
  Description of Artificial Sequence: Synthetic peptide
DIVLTQSPLSLPVTPGDPASISC

SEQ ID NO: 6005 - protein, 23 aa, Artificial Sequence
  Description of Artificial Sequence: Synthetic peptide
DIVLTQSPLSLPVSPGEPASISC

SEQ ID NO: 6006 - protein, 23 aa, Artificial Sequence
  Description of Artificial Sequence: Synthetic peptide
DIVMTQSPLSLPVTPGEPASISC

SEQ ID NO: 6007 - protein, 23 aa, Artificial Sequence
  Description of Artificial Sequence: Synthetic peptide
DIVLTQSPLSLPVTPGDPASISC

SEQ ID NO: 6008 - protein, 23 aa, Artificial Sequence
  Description of Artificial Sequence: Synthetic peptide
DIVMTQSPLSLPVTPGEPASISC

SEQ ID NO: 6009 - protein, 23 aa, Artificial Sequence
  Description of Artificial Sequence: Synthetic peptide
DIVLTQSPLSLPVSPGEPASISC

SEQ ID NO: 6010 - protein, 23 aa, Artificial Sequence
  Description of Artificial Sequence: Synthetic peptide
DIQMTQSPSSVSASVGDRVTITC

SEQ ID NO: 6011 - protein, 23 aa, Artificial Sequence
  Description of Artificial Sequence: Synthetic peptide
DIQMTQSPSSVSASVGDRVTITC

SEQ ID NO: 6012 - protein, 23 aa, Artificial Sequence
  Description of Artificial Sequence: Synthetic peptide
DIQMTQSPSSVSASVGDRVTITC

SEQ ID NO: 6013 - protein, 23 aa, Artificial Sequence
  Description of Artificial Sequence: Synthetic peptide
DIQMTQSPSSVSASVGDRVTITC

SEQ ID NO: 6014 - protein, 23 aa, Artificial Sequence
  Description of Artificial Sequence: Synthetic peptide
DIQMTQSPSSLSASVGDRVTITC

SEQ ID NO: 6015 - protein, 23 aa, Artificial Sequence
  Description of Artificial Sequence: Synthetic peptide
DIQMTQSPSSLSASVGDRVTITC

SEQ ID NO: 6016 - protein, 23 aa, Artificial Sequence
  Description of Artificial Sequence: Synthetic peptide
DIQMTQSPSSLSASVGDRVTITC

SEQ ID NO: 6017 - protein, 23 aa, Artificial Sequence
  Description of Artificial Sequence: Synthetic peptide
DIVMTQTPLSLPVTPGEPASISC

SEQ ID NO: 6018 - protein, 23 aa, Artificial Sequence
  Description of Artificial Sequence: Synthetic peptide
DIVMTQTPLSLPVTPGEPASISC

SEQ ID NO: 6019 - protein, 23 aa, Artificial Sequence
  Description of Artificial Sequence: Synthetic peptide
DIVMTQTPLSLPVTPGEPASISC

SEQ ID NO: 6020 - protein, 22 aa, Artificial Sequence
  Description of Artificial Sequence: Synthetic peptide
QTVVTQEPSLTVSPGGTVTLTC

SEQ ID NO: 6021 - protein, 22 aa, Artificial Sequence
  Description of Artificial Sequence: Synthetic peptide
QTVVTQEPSLTVSPGGTVTLTC

SEQ ID NO: 6022 - protein, 22 aa, Artificial Sequence
  Description of Artificial Sequence: Synthetic peptide
QTVVTQEPSLTVSPGGTVTLTC

SEQ ID NO: 6023 - protein, 22 aa, Artificial Sequence
  Description of Artificial Sequence: Synthetic peptide
QTVVTQEPSLTVSPGGTVTLTC

SEQ ID NO: 6024 - protein, 22 aa, Artificial Sequence
  Description of Artificial Sequence: Synthetic peptide
QTVVTQEPSLTVSPGGTVTLTC

SEQ ID NO: 6025 - protein, 22 aa, Artificial Sequence
  Description of Artificial Sequence: Synthetic peptide
QTVVTQEPSLTVSPGGTVTLTC

SEQ ID NO: 6026 - protein, 22 aa, Artificial Sequence
  Description of Artificial Sequence: Synthetic peptide
QTVVTQEPSLTVSPGGTVTLTC

SEQ ID NO: 6027 - protein, 22 aa, Artificial Sequence
  Description of Artificial Sequence: Synthetic peptide
QTVVTQEPSLTVSPGGTVTLTC

SEQ ID NO: 6028 - protein, 22 aa, Artificial Sequence
  Description of Artificial Sequence: Synthetic peptide
QTVVTQEPSLTVSPGGTVTLTC

SEQ ID NO: 6029 - protein, 22 aa, Artificial Sequence
  Description of Artificial Sequence: Synthetic peptide
QTVVTQEPSLTVSPGGTVTLTC

SEQ ID NO: 6030 - protein, 22 aa, Artificial Sequence
  Description of Artificial Sequence: Synthetic peptide
QTVVTQEPSLTVSPGGTVTLTC

SEQ ID NO: 6031 - protein, 22 aa, Artificial Sequence
  Description of Artificial Sequence: Synthetic peptide
QTVVTQEPSLTVSPGGTVTLTC

SEQ ID NO: 6032 - protein, 22 aa, Artificial Sequence
  Description of Artificial Sequence: Synthetic peptide
QTVVTQEPSLTVSPGGTVTLTC

SEQ ID NO: 6033 - protein, 22 aa, Artificial Sequence
  Description of Artificial Sequence: Synthetic peptide
QTVVTQEPSLTVSPGGTVTLTC

SEQ ID NO: 6034 - protein, 22 aa, Artificial Sequence
  Description of Artificial Sequence: Synthetic peptide
QTVVTQEPSLTVSPGGTVTLTC

SEQ ID NO: 6035 - protein, 22 aa, Artificial Sequence
  Description of Artificial Sequence: Synthetic peptide
QTVVTQEPSLTVSPGGTVTLTC

SEQ ID NO: 6036 - protein, 22 aa, Artificial Sequence
  Description of Artificial Sequence: Synthetic peptide
QTVVTQEPSLTVSPGGTVTLTC

SEQ ID NO: 6037 - protein, 22 aa, Artificial Sequence
  Description of Artificial Sequence: Synthetic peptide
QTVVTQEPSLTVSPGGTVTLTC

SEQ ID NO: 6038 - protein, 22 aa, Artificial Sequence
  Description of Artificial Sequence: Synthetic peptide
QTVVTQEPSLTVSPGGTVTLTC

SEQ ID NO: 6039 - protein, 22 aa, Artificial Sequence
  Description of Artificial Sequence: Synthetic peptide
QTVVTQEPSLTVSPGGTVTLTC

SEQ ID NO: 6040 - protein, 22 aa, Artificial Sequence
  Description of Artificial Sequence: Synthetic peptide
QTVVTQEPSLTVSPGGTVTLTC

SEQ ID NO: 6041 - protein, 22 aa, Artificial Sequence
  Description of Artificial Sequence: Synthetic peptide
QTVVTQEPSLTVSPGGTVTLTC

SEQ ID NO: 6042 - protein, 22 aa, Artificial Sequence
  Description of Artificial Sequence: Synthetic peptide
QTVVTQEPSLTVSPGGTVTLTC

SEQ ID NO: 6043 - protein, 22 aa, Artificial Sequence
  Description of Artificial Sequence: Synthetic peptide
QTVVTQEPSLTVSPGGTVTLTC

SEQ ID NO: 6044 - protein, 22 aa, Artificial Sequence
  Description of Artificial Sequence: Synthetic peptide
QTVVTQEPSLTVSPGGTVTLTC

SEQ ID NO: 6045 - protein, 30 aa, Artificial Sequence; identical to SEQ ID NO: 832
  Description of Artificial Sequence: Synthetic polypeptide

SEQ ID NO: 6046 - protein, 30 aa, Artificial Sequence; identical to SEQ ID NO: 832
  Description of Artificial Sequence: Synthetic polypeptide

SEQ ID NO: 6047 - protein, 30 aa, Artificial Sequence; identical to SEQ ID NO: 832
  Description of Artificial Sequence: Synthetic polypeptide

SEQ ID NO: 6048 - protein, 30 aa, Artificial Sequence; identical to SEQ ID NO: 793
  Description of Artificial Sequence: Synthetic polypeptide

SEQ ID NO: 6049 - protein, 30 aa, Artificial Sequence; identical to SEQ ID NO: 794
  Description of Artificial Sequence: Synthetic polypeptide

SEQ ID NO: 6050 - protein, 30 aa, Artificial Sequence; identical to SEQ ID NO: 794
  Description of Artificial Sequence: Synthetic polypeptide

SEQ ID NO: 6051 - protein, 30 aa, Artificial Sequence; identical to SEQ ID NO: 794
  Description of Artificial Sequence: Synthetic polypeptide

SEQ ID NO: 6052 - protein, 30 aa, Artificial Sequence; identical to SEQ ID NO: 794
  Description of Artificial Sequence: Synthetic polypeptide

SEQ ID NO: 6053 - protein, 30 aa, Artificial Sequence; identical to SEQ ID NO: 794
  Description of Artificial Sequence: Synthetic polypeptide

SEQ ID NO: 6054 - protein, 30 aa, Artificial Sequence; identical to SEQ ID NO: 794
  Description of Artificial Sequence: Synthetic polypeptide

SEQ ID NO: 6055 - protein, 30 aa, Artificial Sequence; identical to SEQ ID NO: 794
  Description of Artificial Sequence: Synthetic polypeptide

SEQ ID NO: 6056 - protein, 30 aa, Artificial Sequence; identical to SEQ ID NO: 794
  Description of Artificial Sequence: Synthetic polypeptide

SEQ ID NO: 6057 - protein, 30 aa, Artificial Sequence; identical to SEQ ID NO: 794
  Description of Artificial Sequence: Synthetic polypeptide

SEQ ID NO: 6058 - protein, 30 aa, Artificial Sequence; identical to SEQ ID NO: 794
  Description of Artificial Sequence: Synthetic polypeptide

SEQ ID NO: 6059 - protein, 30 aa, Artificial Sequence; identical to SEQ ID NO: 794
  Description of Artificial Sequence: Synthetic polypeptide

SEQ ID NO: 6060 - protein, 30 aa, Artificial Sequence; identical to SEQ ID NO: 794
  Description of Artificial Sequence: Synthetic polypeptide

SEQ ID NO: 6061 - protein, 30 aa, Artificial Sequence; identical to SEQ ID NO: 794
  Description of Artificial Sequence: Synthetic polypeptide

SEQ ID NO: 6062 - protein, 30 aa, Artificial Sequence; identical to SEQ ID NO: 794
  Description of Artificial Sequence: Synthetic polypeptide

SEQ ID NO: 6063 - protein, 30 aa, Artificial Sequence; identical to SEQ ID NO: 794
  Description of Artificial Sequence: Synthetic polypeptide

SEQ ID NO: 6064 - protein, 30 aa, Artificial Sequence; identical to SEQ ID NO: 794
  Description of Artificial Sequence: Synthetic polypeptide

SEQ ID NO: 6065 - protein, 30 aa, Artificial Sequence; identical to SEQ ID NO: 794
  Description of Artificial Sequence: Synthetic polypeptide

SEQ ID NO: 6066 - protein, 30 aa, Artificial Sequence; identical to SEQ ID NO: 794
  Description of Artificial Sequence: Synthetic polypeptide

SEQ ID NO: 6067 - protein, 30 aa, Artificial Sequence; identical to SEQ ID NO: 794
  Description of Artificial Sequence: Synthetic polypeptide

SEQ ID NO: 6068 - protein, 30 aa, Artificial Sequence; identical to SEQ ID NO: 794
  Description of Artificial Sequence: Synthetic polypeptide

SEQ ID NO: 6069 - protein, 30 aa, Artificial Sequence; identical to SEQ ID NO: 794
  Description of Artificial Sequence: Synthetic polypeptide

SEQ ID NO: 6070 - protein, 30 aa, Artificial Sequence; identical to SEQ ID NO: 794
  Description of Artificial Sequence: Synthetic polypeptide

SEQ ID NO: 6071 - protein, 30 aa, Artificial Sequence; identical to SEQ ID NO: 794
  Description of Artificial Sequence: Synthetic polypeptide

SEQ ID NO: 6072 - protein, 30 aa, Artificial Sequence; identical to SEQ ID NO: 794
  Description of Artificial Sequence: Synthetic polypeptide

SEQ ID NO: 6073 - protein, 30 aa, Artificial Sequence; identical to SEQ ID NO: 779
  Description of Artificial Sequence: Synthetic polypeptide

SEQ ID NO: 6074 - protein, 30 aa, Artificial Sequence; identical to SEQ ID NO: 779
  Description of Artificial Sequence: Synthetic polypeptide

SEQ ID NO: 6075 - protein, 30 aa, Artificial Sequence; identical to SEQ ID NO: 779
  Description of Artificial Sequence: Synthetic polypeptide

SEQ ID NO: 6076 - protein, 30 aa, Artificial Sequence; identical to SEQ ID NO: 779
  Description of Artificial Sequence: Synthetic polypeptide

SEQ ID NO: 6077 - protein, 30 aa, Artificial Sequence; identical to SEQ ID NO: 779
  Description of Artificial Sequence: Synthetic polypeptide

SEQ ID NO: 6078 - protein, 30 aa, Artificial Sequence; identical to SEQ ID NO: 4049
  Description of Artificial Sequence: Synthetic polypeptide

SEQ ID NO: 6079 - protein, 30 aa, Artificial Sequence; identical to SEQ ID NO: 4050
  Description of Artificial Sequence: Synthetic polypeptide

SEQ ID NO: 6080 - protein, 30 aa, Artificial Sequence; identical to SEQ ID NO: 4050
  Description of Artificial Sequence: Synthetic polypeptide

SEQ ID NO: 6081 - protein, 30 aa, Artificial Sequence; identical to SEQ ID NO: 4049
  Description of Artificial Sequence: Synthetic polypeptide

SEQ ID NO: 6082 - protein, 30 aa, Artificial Sequence; identical to SEQ ID NO: 4052
  Description of Artificial Sequence: Synthetic polypeptide

SEQ ID NO: 6083 - protein, 30 aa, Artificial Sequence; identical to SEQ ID NO: 4052
  Description of Artificial Sequence: Synthetic polypeptide

SEQ ID NO: 6084 - protein, 30 aa, Artificial Sequence; identical to SEQ ID NO: 4049
  Description of Artificial Sequence: Synthetic polypeptide

SEQ ID NO: 6085 - protein, 30 aa, Artificial Sequence; identical to SEQ ID NO: 4050
  Description of Artificial Sequence: Synthetic polypeptide

SEQ ID NO: 6086 - protein, 30 aa, Artificial Sequence; identical to SEQ ID NO: 4050
  Description of Artificial Sequence: Synthetic polypeptide

SEQ ID NO: 6087 - protein, 30 aa, Artificial Sequence; identical to SEQ ID NO: 3145
  Description of Artificial Sequence: Synthetic polypeptide

SEQ ID NO: 6088 - protein, 30 aa, Artificial Sequence; identical to SEQ ID NO: 3145
  Description of Artificial Sequence: Synthetic polypeptide

SEQ ID NO: 6089 - protein, 30 aa, Artificial Sequence; identical to SEQ ID NO: 3145
  Description of Artificial Sequence: Synthetic polypeptide

SEQ ID NO: 6090 - protein, 30 aa, Artificial Sequence; identical to SEQ ID NO: 853
  Description of Artificial Sequence: Synthetic polypeptide

SEQ ID NO: 6091 - protein, 30 aa, Artificial Sequence; identical to SEQ ID NO: 4060
  Description of Artificial Sequence: Synthetic polypeptide

SEQ ID NO: 6092 - protein, 30 aa, Artificial Sequence; identical to SEQ ID NO: 4060
  Description of Artificial Sequence: Synthetic polypeptide

SEQ ID NO: 6093 - protein, 30 aa, Artificial Sequence; identical to SEQ ID NO: 5230
  Description of Artificial Sequence: Synthetic polypeptide

SEQ ID NO: 6094 - protein, 30 aa, Artificial Sequence; identical to SEQ ID NO: 5230
  Description of Artificial Sequence: Synthetic polypeptide

SEQ ID NO: 6095 - protein, 30 aa, Artificial Sequence; identical to SEQ ID NO: 5230
  Description of Artificial Sequence: Synthetic polypeptide

SEQ ID NO: 6096 - protein, 30 aa, Artificial Sequence; identical to SEQ ID NO: 4057
  Description of Artificial Sequence: Synthetic polypeptide

SEQ ID NO: 6097 - protein, 30 aa, Artificial Sequence; identical to SEQ ID NO: 4057
  Description of Artificial Sequence: Synthetic polypeptide

SEQ ID NO: 6098 - protein, 30 aa, Artificial Sequence; identical to SEQ ID NO: 4057
  Description of Artificial Sequence: Synthetic polypeptide

SEQ ID NO: 6099 - protein, 30 aa, Artificial Sequence; identical to SEQ ID NO: 3145
  Description of Artificial Sequence: Synthetic polypeptide

SEQ ID NO: 6100 - protein, 30 aa, Artificial Sequence; identical to SEQ ID NO: 5237
  Description of Artificial Sequence: Synthetic polypeptide

SEQ ID NO: 6101 - protein, 30 aa, Artificial Sequence; identical to SEQ ID NO: 5237
  Description of Artificial Sequence: Synthetic polypeptide

SEQ ID NO: 6102 - protein, 30 aa, Artificial Sequence; identical to SEQ ID NO: 858
  Description of Artificial Sequence: Synthetic polypeptide

SEQ ID NO: 6103 - protein, 30 aa, Artificial Sequence; identical to SEQ ID NO: 859
  Description of Artificial Sequence: Synthetic polypeptide

SEQ ID NO: 6104 - protein, 30 aa, Artificial Sequence; identical to SEQ ID NO: 859
  Description of Artificial Sequence: Synthetic polypeptide

SEQ ID NO: 6105 - protein, 12 aa, Artificial Sequence
  Description of Artificial Sequence: Synthetic peptide
RASQSVSSSYLA

SEQ ID NO: 6106 - protein, 12 aa, Artificial Sequence
  Description of Artificial Sequence: Synthetic peptide
RASQSVSSSYLA

SEQ ID NO: 6107 - protein, 12 aa, Artificial Sequence
  Description of Artificial Sequence: Synthetic peptide
RASQSVSSSYLA

SEQ ID NO: 6108 - protein, 12 aa, Artificial Sequence
  Description of Artificial Sequence: Synthetic peptide
RASQSVSSSYLA

SEQ ID NO: 6109 - protein, 11 aa, Artificial Sequence
  Description of Artificial Sequence: Synthetic peptide
RASQGISNYLA

SEQ ID NO: 6110 - protein, 11 aa, Artificial Sequence
  Description of Artificial Sequence: Synthetic peptide
RASQGISNYLA

SEQ ID NO: 6111 - protein, 11 aa, Artificial Sequence
  Description of Artificial Sequence: Synthetic peptide
RASQGISNYLA

SEQ ID NO: 6112 - protein, 17 aa, Artificial Sequence
  Description of Artificial Sequence: Synthetic peptide
KSSQSVLYSSNNKNYLA

SEQ ID NO: 6113 - protein, 17 aa, Artificial Sequence
  Description of Artificial Sequence: Synthetic peptide
KSSQSLLYSSNQKNYLA

SEQ ID NO: 6114 - protein, 17 aa, Artificial Sequence
  Description of Artificial Sequence: Synthetic peptide
KSSQSLLYSSNQKNYLA

SEQ ID NO: 6115 - protein, 11 aa, Artificial Sequence
  Description of Artificial Sequence: Synthetic peptide
RASQSIGSSLH

SEQ ID NO: 6116 - protein, 10 aa, Artificial Sequence
  Description of Artificial Sequence: Synthetic peptide
SASSNVNYIH

SEQ ID NO: 6117 - protein, 10 aa, Artificial Sequence
  Description of Artificial Sequence: Synthetic peptide
SASSNVNYIH

SEQ ID NO: 6118 - protein, 11 aa, Artificial Sequence
  Description of Artificial Sequence: Synthetic peptide
RASQGIRNDLG

SEQ ID NO: 6119 - protein, 11 aa, Artificial Sequence
  Description of Artificial Sequence: Synthetic peptide
RASGNIHNYLA

SEQ ID NO: 6120 - protein, 11 aa, Artificial Sequence
  Description of Artificial Sequence: Synthetic peptide
RASGNIHNYLA

SEQ ID NO: 6121 - protein, 16 aa, Artificial Sequence
  Description of Artificial Sequence: Synthetic peptide
RSSQSLLHSNGYNYLD

SEQ ID NO: 6122 - protein, 16 aa, Artificial Sequence
  Description of Artificial Sequence: Synthetic peptide
RSSQSLLYSNGYNYVD

SEQ ID NO: 6123 - protein, 16 aa, Artificial Sequence
  Description of Artificial Sequence: Synthetic peptide
RSSQSLLYSNGYNYVD

SEQ ID NO: 6124 - protein, 12 aa, Artificial Sequence
  Description of Artificial Sequence: Synthetic peptide
RASQSVSSSYLA

SEQ ID NO: 6125 - protein, 12 aa, Artificial Sequence
  Description of Artificial Sequence: Synthetic peptide
RASQSVSSSYLA

SEQ ID NO: 6126 - protein, 16 aa, Artificial Sequence
  Description of Artificial Sequence: Synthetic peptide
RSSQSLLHSNGYNYLD

SEQ ID NO: 6127 - protein, 16 aa, Artificial Sequence
  Description of Artificial Sequence: Synthetic peptide
RSSQSLLHSNGYNYLD

SEQ ID NO: 6128 - protein, 16 aa, Artificial Sequence
  Description of Artificial Sequence: Synthetic peptide
RSSQSLLYSNGYNYVD

SEQ ID NO: 6129 - protein, 16 aa, Artificial Sequence
  Description of Artificial Sequence: Synthetic peptide
RSSQSLLHSNGYNYLD

SEQ ID NO: 6130 - protein, 16 aa, Artificial Sequence
  Description of Artificial Sequence: Synthetic peptide
RSSQSLLHSNGYNYLD

SEQ ID NO: 6131 - protein, 16 aa, Artificial Sequence
  Description of Artificial Sequence: Synthetic peptide
RSSQSLLHSNGYNYLD

SEQ ID NO: 6132 - protein, 16 aa, Artificial Sequence
  Description of Artificial Sequence: Synthetic peptide
RSSQSLLYSNGYNYVD

SEQ ID NO: 6133 - protein, 11 aa, Artificial Sequence
  Description of Artificial Sequence: Synthetic peptide
RASQGISSWLA

SEQ ID NO: 6134 - protein, 11 aa, Artificial Sequence
  Description of Artificial Sequence: Synthetic peptide
RASQSISSYLN

SEQ ID NO: 6135 - protein, 11 aa, Artificial Sequence
  Description of Artificial Sequence: Synthetic peptide
RASQGISSWLA

SEQ ID NO: 6136 - protein, 11 aa, Artificial Sequence
  Description of Artificial Sequence: Synthetic peptide
RASQSISSYLN

SEQ ID NO: 6137 - protein, 11 aa, Artificial Sequence
  Description of Artificial Sequence: Synthetic peptide
RASQGISNYLA

SEQ ID NO: 6138 - protein, 11 aa, Artificial Sequence
  Description of Artificial Sequence: Synthetic peptide
RASQGISNYLA

SEQ ID NO: 6139 - protein, 11 aa, Artificial Sequence
  Description of Artificial Sequence: Synthetic peptide
RASQGISNYLA

SEQ ID NO: 6140 - protein, 17 aa, Artificial Sequence
  Description of Artificial Sequence: Synthetic peptide
RSSQSLLDSDDGNTYLD

SEQ ID NO: 6141 - protein, 16 aa, Artificial Sequence
  Description of Artificial Sequence: Synthetic peptide
RSSQSLLHSNGYNYLD

SEQ ID NO: 6142 - protein, 16 aa, Artificial Sequence
  Description of Artificial Sequence: Synthetic peptide
RSSQSLLHSNGYNYLD

SEQ ID NO: 6143 - protein, 14 aa, Artificial Sequence
  Description of Artificial Sequence: Synthetic peptide
ASSTGAVTSGYYPN

SEQ ID NO: 6144 - protein, 14 aa, Artificial Sequence
  Description of Artificial Sequence: Synthetic peptide
GSSTGAVTSGNYPN

SEQ ID NO: 6145 - protein, 14 aa, Artificial Sequence
  Description of Artificial Sequence: Synthetic peptide
GSSTGAVTSGNYPN

SEQ ID NO: 6146 - protein, 14 aa, Artificial Sequence
  Description of Artificial Sequence: Synthetic peptide
GSSTGAVTSGNYPN

SEQ ID NO: 6147 - protein, 14 aa, Artificial Sequence
  Description of Artificial Sequence: Synthetic peptide
GSSTGAVTSGNYPN

SEQ ID NO: 6148 - protein, 14 aa, Artificial Sequence
  Description of Artificial Sequence: Synthetic peptide
GSSTGAVTSGNYPN

SEQ ID NO: 6149 - protein, 14 aa, Artificial Sequence
  Description of Artificial Sequence: Synthetic peptide
GSSTGAVTSGNYPN

SEQ ID NO: 6150 - protein, 14 aa, Artificial Sequence
  Description of Artificial Sequence: Synthetic peptide
GSSTGAVTSGNYPN

SEQ ID NO: 6151 - protein, 14 aa, Artificial Sequence
  Description of Artificial Sequence: Synthetic peptide
GSSTGAVTSGNYPN

SEQ ID NO: 6152 - protein, 14 aa, Artificial Sequence
  Description of Artificial Sequence: Synthetic peptide
GSSTGAVTSGNYPN

SEQ ID NO: 6153 - protein, 14 aa, Artificial Sequence
  Description of Artificial Sequence: Synthetic peptide
GSSTGAVTSGNYPN

SEQ ID NO: 6154 - protein, 14 aa, Artificial Sequence
  Description of Artificial Sequence: Synthetic peptide
GSSTGAVTSGNYPN

SEQ ID NO: 6155 - protein, 14 aa, Artificial Sequence
  Description of Artificial Sequence: Synthetic peptide
GSSTGAVTSGNYPN

SEQ ID NO: 6156 - protein, 14 aa, Artificial Sequence
  Description of Artificial Sequence: Synthetic peptide
GSSTGAVTSGNYPN

SEQ ID NO: 6157 - protein, 14 aa, Artificial Sequence
  Description of Artificial Sequence: Synthetic peptide
GSSTGAVTSGNYPN

SEQ ID NO: 6158 - protein, 14 aa, Artificial Sequence
  Description of Artificial Sequence: Synthetic peptide
GSSTGAVTSGNYPN

SEQ ID NO: 6159 - protein, 14 aa, Artificial Sequence
  Description of Artificial Sequence: Synthetic peptide
GSSTGAVTSGNYPN

SEQ ID NO: 6160 - protein, 14 aa, Artificial Sequence
  Description of Artificial Sequence: Synthetic peptide
GSSTGAVTSGNYPN

SEQ ID NO: 6161 - protein, 14 aa, Artificial Sequence
  Description of Artificial Sequence: Synthetic peptide
GSSTGAVTSGNYPN

SEQ ID NO: 6162 - protein, 14 aa, Artificial Sequence
  Description of Artificial Sequence: Synthetic peptide
GSSTGAVTSGNYPN

SEQ ID NO: 6163 - protein, 14 aa, Artificial Sequence
  Description of Artificial Sequence: Synthetic peptide
GSSTGAVTSGNYPN

SEQ ID NO: 6164 - protein, 14 aa, Artificial Sequence
  Description of Artificial Sequence: Synthetic peptide
GSSTGAVTSGNYPN

SEQ ID NO: 6165 - protein, 14 aa, Artificial Sequence
  Description of Artificial Sequence: Synthetic peptide
GSSTGAVTSGNYPN

SEQ ID NO: 6166 - protein, 14 aa, Artificial Sequence
  Description of Artificial Sequence: Synthetic peptide
GSSTGAVTSGNYPN

SEQ ID NO: 6167 - protein, 14 aa, Artificial Sequence
  Description of Artificial Sequence: Synthetic peptide
GSSTGAVTSGNYPN

SEQ ID NO: 6168 - protein, 5 aa, Artificial Sequence
  Description of Artificial Sequence: Synthetic peptide
SYSMN

SEQ ID NO: 6169 - protein, 5 aa, Artificial Sequence
  Description of Artificial Sequence: Synthetic peptide
TYSMN

SEQ ID NO: 6170 - protein, 5 aa, Artificial Sequence
  Description of Artificial Sequence: Synthetic peptide
TYSMN

SEQ ID NO: 6171 - protein, 5 aa, Artificial Sequence
  Description of Artificial Sequence: Synthetic peptide
GSAMH

SEQ ID NO: 6172 - protein, 5 aa, Artificial Sequence
  Description of Artificial Sequence: Synthetic peptide
KYAMN

SEQ ID NO: 6173 - protein, 5 aa, Artificial Sequence
  Description of Artificial Sequence: Synthetic peptide
KYAMN

SEQ ID NO: 6174 - protein, 5 aa, Artificial Sequence
  Description of Artificial Sequence: Synthetic peptide
KYAMN

SEQ ID NO: 6175 - protein, 5 aa, Artificial Sequence
  Description of Artificial Sequence: Synthetic peptide
KYAMN

SEQ ID NO: 6176 - protein, 5 aa, Artificial Sequence
  Description of Artificial Sequence: Synthetic peptide
KYAMN

SEQ ID NO: 6177 - protein, 5 aa, Artificial Sequence
  Description of Artificial Sequence: Synthetic peptide
KYAMN

SEQ ID NO: 6178 - protein, 5 aa, Artificial Sequence
  Description of Artificial Sequence: Synthetic peptide
KYAMN

SEQ ID NO: 6179 - protein, 5 aa, Artificial Sequence
  Description of Artificial Sequence: Synthetic peptide
KYAMN

SEQ ID NO: 6180 - protein, 5 aa, Artificial Sequence
  Description of Artificial Sequence: Synthetic peptide
KYAMN

SEQ ID NO: 6181 - protein, 5 aa, Artificial Sequence
  Description of Artificial Sequence: Synthetic peptide
KYAMN

SEQ ID NO: 6182 - protein, 5 aa, Artificial Sequence
  Description of Artificial Sequence: Synthetic peptide
KYAMN

SEQ ID NO: 6183 - protein, 5 aa, Artificial Sequence
  Description of Artificial Sequence: Synthetic peptide
KYAMN

SEQ ID NO: 6184 - protein, 5 aa, Artificial Sequence
  Description of Artificial Sequence: Synthetic peptide
KYAMN

SEQ ID NO: 6185 - protein, 5 aa, Artificial Sequence
  Description of Artificial Sequence: Synthetic peptide
KYAMN

SEQ ID NO: 6186 - protein, 5 aa, Artificial Sequence
  Description of Artificial Sequence: Synthetic peptide
KYAMN

SEQ ID NO: 6187 - protein, 5 aa, Artificial Sequence
  Description of Artificial Sequence: Synthetic peptide
KYAMN

SEQ ID NO: 6188 - protein, 5 aa, Artificial Sequence
  Description of Artificial Sequence: Synthetic peptide
KYAMN

SEQ ID NO: 6189 - protein, 5 aa, Artificial Sequence
  Description of Artificial Sequence: Synthetic peptide
KYAMN

SEQ ID NO: 6190 - protein, 5 aa, Artificial Sequence
  Description of Artificial Sequence: Synthetic peptide
KYAMN

SEQ ID NO: 6191 - protein, 5 aa, Artificial Sequence
  Description of Artificial Sequence: Synthetic peptide
KYAMN

SEQ ID NO: 6192 - protein, 5 aa, Artificial Sequence
  Description of Artificial Sequence: Synthetic peptide
KYAMN

SEQ ID NO: 6193 - protein, 5 aa, Artificial Sequence
  Description of Artificial Sequence: Synthetic peptide
KYAMN

SEQ ID NO: 6194 - protein, 5 aa, Artificial Sequence
  Description of Artificial Sequence: Synthetic peptide
KYAMN

SEQ ID NO: 6195 - protein, 5 aa, Artificial Sequence
  Description of Artificial Sequence: Synthetic peptide
KYAMN

SEQ ID NO: 6196 - protein, 5 aa, Artificial Sequence
  Description of Artificial Sequence: Synthetic peptide
SYAMS

SEQ ID NO: 6197 - protein, 5 aa, Artificial Sequence
  Description of Artificial Sequence: Synthetic peptide
SFAMS

SEQ ID NO: 6198 - protein, 5 aa, Artificial Sequence
  Description of Artificial Sequence: Synthetic peptide
SFAMS

SEQ ID NO: 6199 - protein, 5 aa, Artificial Sequence
  Description of Artificial Sequence: Synthetic peptide
SFAMS

SEQ ID NO: 6200 - protein, 5 aa, Artificial Sequence
  Description of Artificial Sequence: Synthetic peptide
SFAMS

SEQ ID NO: 6201 - protein, 5 aa, Artificial Sequence
  Description of Artificial Sequence: Synthetic peptide
SYAIS

SEQ ID NO: 6202 - protein, 5 aa, Artificial Sequence
  Description of Artificial Sequence: Synthetic peptide
KSWMN

SEQ ID NO: 6203 - protein, 5 aa, Artificial Sequence
  Description of Artificial Sequence: Synthetic peptide
KSWMN

SEQ ID NO: 6204 - protein, 5 aa, Artificial Sequence
  Description of Artificial Sequence: Synthetic peptide
SYAIS

SEQ ID NO: 6205 - protein, 5 aa, Artificial Sequence
  Description of Artificial Sequence: Synthetic peptide
KSWMN

SEQ ID NO: 6206 - protein, 5 aa, Artificial Sequence
  Description of Artificial Sequence: Synthetic peptide
KSWMN

SEQ ID NO: 6207 - protein, 5 aa, Artificial Sequence
  Description of Artificial Sequence: Synthetic peptide
SYAIS

SEQ ID NO: 6208 - protein, 5 aa, Artificial Sequence
  Description of Artificial Sequence: Synthetic peptide
SSWMN

SEQ ID NO: 6209 - protein, 5 aa, Artificial Sequence
  Description of Artificial Sequence: Synthetic peptide
SSWMN

SEQ ID NO: 6210 - protein, 5 aa, Artificial Sequence
  Description of Artificial Sequence: Synthetic peptide
SYDIN

SEQ ID NO: 6211 - protein, 5 aa, Artificial Sequence
  Description of Artificial Sequence: Synthetic peptide
SYDIN

SEQ ID NO: 6212 - protein, 5 aa, Artificial Sequence
  Description of Artificial Sequence: Synthetic peptide
SYDIN

SEQ ID NO: 6213 - protein, 5 aa, Artificial Sequence
  Description of Artificial Sequence: Synthetic peptide
SYAMH

SEQ ID NO: 6214 - protein, 5 aa, Artificial Sequence
  Description of Artificial Sequence: Synthetic peptide
SYRMH

SEQ ID NO: 6215 - protein, 5 aa, Artificial Sequence
  Description of Artificial Sequence: Synthetic peptide
SYRMH

SEQ ID NO: 6216 - protein, 7 aa, Artificial Sequence
  Description of Artificial Sequence: Synthetic peptide
SNSAAWN

SEQ ID NO: 6217 - protein, 7 aa, Artificial Sequence
  Description of Artificial Sequence: Synthetic peptide
SNSAAWN

SEQ ID NO: 6218 - protein, 7 aa, Artificial Sequence
  Description of Artificial Sequence: Synthetic peptide
SNSAAWN

SEQ ID NO: 6219 - protein, 5 aa, Artificial Sequence
  Description of Artificial Sequence: Synthetic peptide
GYYWS

SEQ ID NO: 6220 - protein, 5 aa, Artificial Sequence
  Description of Artificial Sequence: Synthetic peptide
GYYWN

SEQ ID NO: 6221 - protein, 5 aa, Artificial Sequence
  Description of Artificial Sequence: Synthetic peptide
GYYWN

SEQ ID NO: 6222 - protein, 5 aa, Artificial Sequence
  Description of Artificial Sequence: Synthetic peptide
GYYMH

SEQ ID NO: 6223 - protein, 5 aa, Artificial Sequence
  Description of Artificial Sequence: Synthetic peptide
GYYMH

SEQ ID NO: 6224 - protein, 5 aa, Artificial Sequence
  Description of Artificial Sequence: Synthetic peptide
GYYMH

SEQ ID NO: 6225 - protein, 7 aa, Artificial Sequence
  Description of Artificial Sequence: Synthetic peptide
SGGYYWS

SEQ ID NO: 6226 - protein, 7 aa, Artificial Sequence
  Description of Artificial Sequence: Synthetic peptide
RDPYYWS

SEQ ID NO: 6227 - protein, 7 aa, Artificial Sequence
  Description of Artificial Sequence: Synthetic peptide
RDPYYWS

SEQ ID NO: 6228 - protein, 15 aa, Artificial Sequence
  Description of Artificial Sequence: Synthetic peptide
WYQQKPGQAPRLLIY

SEQ ID NO: 6229 - protein, 15 aa, Artificial Sequence
  Description of Artificial Sequence: Synthetic peptide
WYQQKPGQAPRLLIY

SEQ ID NO: 6230 - protein, 15 aa, Artificial Sequence
  Description of Artificial Sequence: Synthetic peptide
WYQQKPGQAPRLLIY

SEQ ID NO: 6231 - protein, 15 aa, Artificial Sequence
  Description of Artificial Sequence: Synthetic peptide
WYQQKPGQAPRLLIY

SEQ ID NO: 6232 - protein, 15 aa, Artificial Sequence
  Description of Artificial Sequence: Synthetic peptide
WYQQKPGKVPKLLIY

SEQ ID NO: 6233 - protein, 15 aa, Artificial Sequence
  Description of Artificial Sequence: Synthetic peptide
WYQQKPGKVPKLLIY

SEQ ID NO: 6234 - protein, 15 aa, Artificial Sequence
  Description of Artificial Sequence: Synthetic peptide
WYQQKPGKVPKLLIY

SEQ ID NO: 6235 - protein, 15 aa, Artificial Sequence
  Description of Artificial Sequence: Synthetic peptide
WYQQKPGQPPKLLIY

SEQ ID NO: 6236 - protein, 15 aa, Artificial Sequence
  Description of Artificial Sequence: Synthetic peptide
WYQQKPGQSPKLLIY

SEQ ID NO: 6237 - protein, 15 aa, Artificial Sequence
  Description of Artificial Sequence: Synthetic peptide
WYQQKPGQSPKLLIY

SEQ ID NO: 6238 - protein, 15 aa, Artificial Sequence
  Description of Artificial Sequence: Synthetic peptide
WYQQKPDQSPKLLIK

SEQ ID NO: 6239 - protein, 15 aa, Artificial Sequence
  Description of Artificial Sequence: Synthetic peptide
WYQQKLGSSPKLWIY

SEQ ID NO: 6240 - protein, 15 aa, Artificial Sequence
  Description of Artificial Sequence: Synthetic peptide
WYQQKLGSSPKLWIY

SEQ ID NO: 6241 - protein, 15 aa, Artificial Sequence
  Description of Artificial Sequence: Synthetic peptide
WYQQKPGKAPKLLIY

SEQ ID NO: 6242 - protein, 15 aa, Artificial Sequence
  Description of Artificial Sequence: Synthetic peptide
WYQQKQGKSPQLLVY

SEQ ID NO: 6243 - protein, 15 aa, Artificial Sequence
  Description of Artificial Sequence: Synthetic peptide
WYQQKQGKSPQLLVY

SEQ ID NO: 6244 - protein, 15 aa, Artificial Sequence
  Description of Artificial Sequence: Synthetic peptide
WYLQKPGQSPQLLIY

SEQ ID NO: 6245 - protein, 15 aa, Artificial Sequence
  Description of Artificial Sequence: Synthetic peptide
WYLQKPGQSPQLLIY

SEQ ID NO: 6246 - protein, 15 aa, Artificial Sequence
  Description of Artificial Sequence: Synthetic peptide
WYLQKPGQSPQLLIY

SEQ ID NO: 6247 - protein, 15 aa, Artificial Sequence
  Description of Artificial Sequence: Synthetic peptide
WYQQKPGQAPRLLIY

SEQ ID NO: 6248 - protein, 15 aa, Artificial Sequence
  Description of Artificial Sequence: Synthetic peptide
WYQQKPGQAPRLLIY

SEQ ID NO: 6249 - protein, 15 aa, Artificial Sequence
  Description of Artificial Sequence: Synthetic peptide
WYLQKPGQSPQLLIY

SEQ ID NO: 6250 - protein, 15 aa, Artificial Sequence
  Description of Artificial Sequence: Synthetic peptide
WYLQKPGQSPQLLIY

SEQ ID NO: 6251 - protein, 15 aa, Artificial Sequence
  Description of Artificial Sequence: Synthetic peptide
WYLQKPGQSPQLLIY

SEQ ID NO: 6252 - protein, 15 aa, Artificial Sequence
  Description of Artificial Sequence: Synthetic peptide
WYLQKPGQSPQLLIY

SEQ ID NO: 6253 - protein, 15 aa, Artificial Sequence
  Description of Artificial Sequence: Synthetic peptide
WYLQKPGQSPQLLIY

SEQ ID NO: 6254 - protein, 15 aa, Artificial Sequence
  Description of Artificial Sequence: Synthetic peptide
WYLQKPGQSPQLLIY

SEQ ID NO: 6255 - protein, 15 aa, Artificial Sequence
  Description of Artificial Sequence: Synthetic peptide
WYLQKPGQSPQLLIY

SEQ ID NO: 6256 - protein, 15 aa, Artificial Sequence
  Description of Artificial Sequence: Synthetic peptide
WYQQKPGKAPKLLIY

SEQ ID NO: 6257 - protein, 15 aa, Artificial Sequence
  Description of Artificial Sequence: Synthetic peptide
WYQQKPGKAPKSLIY

SEQ ID NO: 6258 - protein, 15 aa, Artificial Sequence
  Description of Artificial Sequence: Synthetic peptide
WYQQKPGKAPKLLIY

SEQ ID NO: 6259 - protein, 15 aa, Artificial Sequence
  Description of Artificial Sequence: Synthetic peptide
WYQQKPGKAPKSLIY

SEQ ID NO: 6260 - protein, 15 aa, Artificial Sequence
  Description of Artificial Sequence: Synthetic peptide
WYQQKPGKVPKLLIY

SEQ ID NO: 6261 - protein, 15 aa, Artificial Sequence
  Description of Artificial Sequence: Synthetic peptide
WYQQKPGKVPKLLIY

SEQ ID NO: 6262 - protein, 15 aa, Artificial Sequence
  Description of Artificial Sequence: Synthetic peptide
WYQQKPGKVPKLLIY

SEQ ID NO: 6263 - protein, 15 aa, Artificial Sequence
  Description of Artificial Sequence: Synthetic peptide
WYLQKPGQSPQLLIY

SEQ ID NO: 6264 - protein, 15 aa, Artificial Sequence
  Description of Artificial Sequence: Synthetic peptide
WYLQKPGQSPQLLIY

SEQ ID NO: 6265 - protein, 15 aa, Artificial Sequence
  Description of Artificial Sequence: Synthetic peptide
WYLQKPGQSPQLLIY

SEQ ID NO: 6266 - protein, 15 aa, Artificial Sequence
  Description of Artificial Sequence: Synthetic peptide
WFQQKPGQAPRALIY

SEQ ID NO: 6267 - protein, 15 aa, Artificial Sequence
  Description of Artificial Sequence: Synthetic peptide
WVQQKPGQAPRGLIG

SEQ ID NO: 6268 - protein, 15 aa, Artificial Sequence
  Description of Artificial Sequence: Synthetic peptide
WVQQKPGQAPRGLIG

SEQ ID NO: 6269 - protein, 15 aa, Artificial Sequence
  Description of Artificial Sequence: Synthetic peptide
WVQQKPGQAPRGLIG

SEQ ID NO: 6270 - protein, 15 aa, Artificial Sequence
  Description of Artificial Sequence: Synthetic peptide
WVQQKPGQAPRGLIG

SEQ ID NO: 6271 - protein, 15 aa, Artificial Sequence
  Description of Artificial Sequence: Synthetic peptide
WVQQKPGQAPRGLIG

SEQ ID NO: 6272 - protein, 15 aa, Artificial Sequence
  Description of Artificial Sequence: Synthetic peptide
WVQQKPGQAPRGLIG

SEQ ID NO: 6273 - protein, 15 aa, Artificial Sequence
  Description of Artificial Sequence: Synthetic peptide
WVQQKPGQAPRGLIG

SEQ ID NO: 6274 - protein, 15 aa, Artificial Sequence
  Description of Artificial Sequence: Synthetic peptide
WVQQKPGQAPRGLIG

SEQ ID NO: 6275 - protein, 15 aa, Artificial Sequence
  Description of Artificial Sequence: Synthetic peptide
WVQQKPGQAPRGLIG

SEQ ID NO: 6276 - protein, 15 aa, Artificial Sequence
  Description of Artificial Sequence: Synthetic peptide
WVQQKPGQAPRGLIG

SEQ ID NO: 6277 - protein, 15 aa, Artificial Sequence
  Description of Artificial Sequence: Synthetic peptide
WVQQKPGQAPRGLIG

SEQ ID NO: 6278 - protein, 15 aa, Artificial Sequence
  Description of Artificial Sequence: Synthetic peptide
WVQQKPGQAPRGLIG

SEQ ID NO: 6279 - protein, 15 aa, Artificial Sequence
  Description of Artificial Sequence: Synthetic peptide
WVQQKPGQAPRGLIG

SEQ ID NO: 6280 - protein, 15 aa, Artificial Sequence
  Description of Artificial Sequence: Synthetic peptide
WVQQKPGQAPRGLIG

SEQ ID NO: 6281 - protein, 15 aa, Artificial Sequence
  Description of Artificial Sequence: Synthetic peptide
WVQQKPGQAPRGLIG

SEQ ID NO: 6282 - protein, 15 aa, Artificial Sequence
  Description of Artificial Sequence: Synthetic peptide
WVQQKPGQAPRGLIG

SEQ ID NO: 6283 - protein, 15 aa, Artificial Sequence
  Description of Artificial Sequence: Synthetic peptide
WVQQKPGQAPRGLIG

SEQ ID NO: 6284 - protein, 15 aa, Artificial Sequence
  Description of Artificial Sequence: Synthetic peptide
WVQQKPGQAPRGLIG

SEQ ID NO: 6285 - protein, 15 aa, Artificial Sequence
  Description of Artificial Sequence: Synthetic peptide
WVQQKPGQAPRGLIG

SEQ ID NO: 6286 - protein, 15 aa, Artificial Sequence
  Description of Artificial Sequence: Synthetic peptide
WVQQKPGQAPRGLIG

SEQ ID NO: 6287 - protein, 15 aa, Artificial Sequence
  Description of Artificial Sequence: Synthetic peptide
WVQQKPGQAPRGLIG

SEQ ID NO: 6288 - protein, 15 aa, Artificial Sequence
  Description of Artificial Sequence: Synthetic peptide
WVQQKPGQAPRGLIG

SEQ ID NO: 6289 - protein, 15 aa, Artificial Sequence
  Description of Artificial Sequence: Synthetic peptide
WVQQKPGQAPRGLIG

SEQ ID NO: 6290 - protein, 15 aa, Artificial Sequence
  Description of Artificial Sequence: Synthetic peptide
WVQQKPGQAPRGLIG

SEQ ID NO: 6291 - protein, 14 aa, Artificial Sequence
  Description of Artificial Sequence: Synthetic peptide
WVRQAPGKGLEWVS

SEQ ID NO: 6292 - protein, 14 aa, Artificial Sequence
  Description of Artificial Sequence: Synthetic peptide
WVRQAPGKCLEWVS

SEQ ID NO: 6293 - protein, 14 aa, Artificial Sequence
  Description of Artificial Sequence: Synthetic peptide
WVRQAPGKGLEWVS

SEQ ID NO: 6294 - protein, 14 aa, Artificial Sequence
  Description of Artificial Sequence: Synthetic peptide
WVRQASGKGLEWVG

SEQ ID NO: 6295 - protein, 14 aa, Artificial Sequence
  Description of Artificial Sequence: Synthetic peptide
WVRQAPGKGLEWVA

SEQ ID NO: 6296 - protein, 14 aa, Artificial Sequence
  Description of Artificial Sequence: Synthetic peptide
WVRQAPGKGLEWVA

SEQ ID NO: 6297 - protein, 14 aa, Artificial Sequence
  Description of Artificial Sequence: Synthetic peptide
WVRQAPGKGLEWVA

SEQ ID NO: 6298 - protein, 14 aa, Artificial Sequence
  Description of Artificial Sequence: Synthetic peptide
WVRQAPGKGLEWVA

SEQ ID NO: 6299 - protein, 14 aa, Artificial Sequence
  Description of Artificial Sequence: Synthetic peptide
WVRQAPGKGLEWVA

SEQ ID NO: 6300 - protein, 14 aa, Artificial Sequence
  Description of Artificial Sequence: Synthetic peptide
WVRQAPGKGLEWVA

SEQ ID NO: 6301 - protein, 14 aa, Artificial Sequence
  Description of Artificial Sequence: Synthetic peptide
WVRQAPGKGLEWVA

SEQ ID NO: 6302 - protein, 14 aa, Artificial Sequence
  Description of Artificial Sequence: Synthetic peptide
WVRQAPGKGLEWVA

SEQ ID NO: 6303 - protein, 14 aa, Artificial Sequence
  Description of Artificial Sequence: Synthetic peptide
WVRQAPGKGLEWVA

SEQ ID NO: 6304 - protein, 14 aa, Artificial Sequence
  Description of Artificial Sequence: Synthetic peptide
WVRQAPGKGLEWVA

SEQ ID NO: 6305 - protein, 14 aa, Artificial Sequence
  Description of Artificial Sequence: Synthetic peptide
WVRQAPGKGLEWVA

SEQ ID NO: 6306 - protein, 14 aa, Artificial Sequence
  Description of Artificial Sequence: Synthetic peptide
WVRQAPGKGLEWVA

SEQ ID NO: 6307 - protein, 14 aa, Artificial Sequence
  Description of Artificial Sequence: Synthetic peptide
WVRQAPGKGLEWVA

SEQ ID NO: 6308 - protein, 14 aa, Artificial Sequence
  Description of Artificial Sequence: Synthetic peptide
WVRQAPGKGLEWVA

SEQ ID NO: 6309 - protein, 14 aa, Artificial Sequence
  Description of Artificial Sequence: Synthetic peptide
WVRQAPGKGLEWVA

SEQ ID NO: 6310 - protein, 14 aa, Artificial Sequence
  Description of Artificial Sequence: Synthetic peptide
WVRQAPGKGLEWVA

SEQ ID NO: 6311 - protein, 14 aa, Artificial Sequence
  Description of Artificial Sequence: Synthetic peptide
WVRQAPGKGLEWVA

SEQ ID NO: 6312 - protein, 14 aa, Artificial Sequence
  Description of Artificial Sequence: Synthetic peptide
WVRQAPGKGLEWVA

SEQ ID NO: 6313 - protein, 14 aa, Artificial Sequence
  Description of Artificial Sequence: Synthetic peptide
WVRQAPGKGLEWVA

SEQ ID NO: 6314 - protein, 14 aa, Artificial Sequence
  Description of Artificial Sequence: Synthetic peptide
WVRQAPGKGLEWVA

SEQ ID NO: 6315 - protein, 14 aa, Artificial Sequence
  Description of Artificial Sequence: Synthetic peptide
WVRQAPGKGLEWVA

SEQ ID NO: 6316 - protein, 14 aa, Artificial Sequence
  Description of Artificial Sequence: Synthetic peptide
WVRQAPGKGLEWVA

SEQ ID NO: 6317 - protein, 14 aa, Artificial Sequence
  Description of Artificial Sequence: Synthetic peptide
WVRQAPGKGLEWVA

SEQ ID NO: 6318 - protein, 14 aa, Artificial Sequence
  Description of Artificial Sequence: Synthetic peptide
WVRQAPGKGLEWVA

SEQ ID NO: 6319 - protein, 14 aa, Artificial Sequence
  Description of Artificial Sequence: Synthetic peptide
WVRQAPGKGLEWVS

SEQ ID NO: 6320 - protein, 14 aa, Artificial Sequence
  Description of Artificial Sequence: Synthetic peptide
WVRQAPGKCLEWVS

SEQ ID NO: 6321 - protein, 14 aa, Artificial Sequence
  Description of Artificial Sequence: Synthetic peptide
WVRQAPGKGLEWVS

SEQ ID NO: 6322 - protein, 14 aa, Artificial Sequence
  Description of Artificial Sequence: Synthetic peptide
WVRQAPGKCLEWVS

SEQ ID NO: 6323 - protein, 14 aa, Artificial Sequence
  Description of Artificial Sequence: Synthetic peptide
WVRQAPGKGLEWVS

SEQ ID NO: 6324 - protein, 14 aa, Artificial Sequence
  Description of Artificial Sequence: Synthetic peptide
WVRQAPGQGLEWMG

SEQ ID NO: 6325 - protein, 14 aa, Artificial Sequence
  Description of Artificial Sequence: Synthetic peptide
WVKQRPGKCLEWIG

SEQ ID NO: 6326 - protein, 14 aa, Artificial Sequence
  Description of Artificial Sequence: Synthetic peptide
WVKQRPGKGLEWIG

SEQ ID NO: 6327 - protein, 14 aa, Artificial Sequence
  Description of Artificial Sequence: Synthetic peptide
WVRQAPGQGLEWMG

SEQ ID NO: 6328 - protein, 14 aa, Artificial Sequence
  Description of Artificial Sequence: Synthetic peptide
WVKQRPGECLEWIG

SEQ ID NO: 6329 - protein, 14 aa, Artificial Sequence
  Description of Artificial Sequence: Synthetic peptide
WVKQRPGEGLEWIG

SEQ ID NO: 6330 - protein, 14 aa, Artificial Sequence
  Description of Artificial Sequence: Synthetic peptide
WVRQAPGQGLEWMG

SEQ ID NO: 6331 - protein, 14 aa, Artificial Sequence
  Description of Artificial Sequence: Synthetic peptide
WVKQRPGKCLEWIG

SEQ ID NO: 6332 - protein, 14 aa, Artificial Sequence
  Description of Artificial Sequence: Synthetic peptide
WVKQRPGKGLEWIG

SEQ ID NO: 6333 - protein, 14 aa, Artificial Sequence
  Description of Artificial Sequence: Synthetic peptide
WVRQATGQGLEWMG

SEQ ID NO: 6334 - protein, 14 aa, Artificial Sequence
  Description of Artificial Sequence: Synthetic peptide
WVRQATGQCLEWMG

SEQ ID NO: 6335 - protein, 14 aa, Artificial Sequence
  Description of Artificial Sequence: Synthetic peptide
WVRQATGQGLEWMG

SEQ ID NO: 6336 - protein, 14 aa, Artificial Sequence
  Description of Artificial Sequence: Synthetic peptide
WVRQAPGKGLEWVA

SEQ ID NO: 6337 - protein, 14 aa, Artificial Sequence
  Description of Artificial Sequence: Synthetic peptide
WVRQAPGKCLEWVA

SEQ ID NO: 6338 - protein, 14 aa, Artificial Sequence
  Description of Artificial Sequence: Synthetic peptide
WVRQAPGKGLEWVA

SEQ ID NO: 6339 - protein, 14 aa, Artificial Sequence
  Description of Artificial Sequence: Synthetic peptide
WIRQSPSRGLEWLG

SEQ ID NO: 6340 - protein, 14 aa, Artificial Sequence
  Description of Artificial Sequence: Synthetic peptide
WIRQSPSRCLEWLG

SEQ ID NO: 6341 - protein, 14 aa, Artificial Sequence
  Description of Artificial Sequence: Synthetic peptide
WIRQSPSRGLEWLG

SEQ ID NO: 6342 - protein, 14 aa, Artificial Sequence
  Description of Artificial Sequence: Synthetic peptide
WIRQPPGKGLEWIG

SEQ ID NO: 6343 - protein, 14 aa, Artificial Sequence
  Description of Artificial Sequence: Synthetic peptide
WIRQPPGKCLEWIG

SEQ ID NO: 6344 - protein, 14 aa, Artificial Sequence
  Description of Artificial Sequence: Synthetic peptide
WIRQPPGKGLEWIG

SEQ ID NO: 6345 - protein, 14 aa, Artificial Sequence
  Description of Artificial Sequence: Synthetic peptide
WVRQAPGQGLEWMG

SEQ ID NO: 6346 - protein, 14 aa, Artificial Sequence
  Description of Artificial Sequence: Synthetic peptide
WVRQAPGQCLEWMG

SEQ ID NO: 6347 - protein, 14 aa, Artificial Sequence
  Description of Artificial Sequence: Synthetic peptide
WVRQAPGQGLEWMG

SEQ ID NO: 6348 - protein, 14 aa, Artificial Sequence
  Description of Artificial Sequence: Synthetic peptide
WIRQHPGKGLEWIG

SEQ ID NO: 6349 - protein, 14 aa, Artificial Sequence
  Description of Artificial Sequence: Synthetic peptide
WIRQHPGKCLEWIG

SEQ ID NO: 6350 - protein, 14 aa, Artificial Sequence
  Description of Artificial Sequence: Synthetic peptide
WIRQHPGKGLEWIG

SEQ ID NO: 6351 - protein, 7 aa, Artificial Sequence
  Description of Artificial Sequence: Synthetic peptide
GASSRAT

SEQ ID NO: 6352 - protein, 7 aa, Artificial Sequence
  Description of Artificial Sequence: Synthetic peptide
GASSRAT

SEQ ID NO: 6353 - protein, 7 aa, Artificial Sequence
  Description of Artificial Sequence: Synthetic peptide
GASSRAT

SEQ ID NO: 6354 - protein, 7 aa, Artificial Sequence
  Description of Artificial Sequence: Synthetic peptide
GASSRAT

SEQ ID NO: 6355 - protein, 7 aa, Artificial Sequence
  Description of Artificial Sequence: Synthetic peptide
AASTLQS

SEQ ID NO: 6356 - protein, 7 aa, Artificial Sequence
  Description of Artificial Sequence: Synthetic peptide
AASTLQS

SEQ ID NO: 6357 - protein, 7 aa, Artificial Sequence
  Description of Artificial Sequence: Synthetic peptide
AASTLQS

SEQ ID NO: 6358 - protein, 7 aa, Artificial Sequence
  Description of Artificial Sequence: Synthetic peptide
WASTRES

SEQ ID NO: 6359 - protein, 7 aa, Artificial Sequence
  Description of Artificial Sequence: Synthetic peptide
WASTRES

SEQ ID NO: 6360 - protein, 7 aa, Artificial Sequence
  Description of Artificial Sequence: Synthetic peptide
WASTRES

SEQ ID NO: 6361 - protein, 7 aa, Artificial Sequence
  Description of Artificial Sequence: Synthetic peptide
YASQSFS

SEQ ID NO: 6362 - protein, 7 aa, Artificial Sequence
  Description of Artificial Sequence: Synthetic peptide
DTSKLAP

SEQ ID NO: 6363 - protein, 7 aa, Artificial Sequence
  Description of Artificial Sequence: Synthetic peptide
DTSKLAP

SEQ ID NO: 6364 - protein, 7 aa, Artificial Sequence
  Description of Artificial Sequence: Synthetic peptide
AASSLQS

SEQ ID NO: 6365 - protein, 7 aa, Artificial Sequence
  Description of Artificial Sequence: Synthetic peptide
NAKTLAG

SEQ ID NO: 6366 - protein, 7 aa, Artificial Sequence
  Description of Artificial Sequence: Synthetic peptide
NAKTLAG

SEQ ID NO: 6367 - protein, 7 aa, Artificial Sequence
  Description of Artificial Sequence: Synthetic peptide
LGSNRAS

SEQ ID NO: 6368 - protein, 7 aa, Artificial Sequence
  Description of Artificial Sequence: Synthetic peptide
LGSNRAS

SEQ ID NO: 6369 - protein, 7 aa, Artificial Sequence
  Description of Artificial Sequence: Synthetic peptide
LGSNRAS

SEQ ID NO: 6370 - protein, 7 aa, Artificial Sequence
  Description of Artificial Sequence: Synthetic peptide
GASSRAT

SEQ ID NO: 6371 - protein, 7 aa, Artificial Sequence
  Description of Artificial Sequence: Synthetic peptide
GASSRAT

SEQ ID NO: 6372 - protein, 7 aa, Artificial Sequence
  Description of Artificial Sequence: Synthetic peptide
LGSNRAS

SEQ ID NO: 6373 - protein, 7 aa, Artificial Sequence
  Description of Artificial Sequence: Synthetic peptide
LGSNRAS

SEQ ID NO: 6374 - protein, 7 aa, Artificial Sequence
  Description of Artificial Sequence: Synthetic peptide
LGSNRAS

SEQ ID NO: 6375 - protein, 7 aa, Artificial Sequence
  Description of Artificial Sequence: Synthetic peptide
LGSNRAS

SEQ ID NO: 6376 - protein, 7 aa, Artificial Sequence
  Description of Artificial Sequence: Synthetic peptide
LGSNRAS

SEQ ID NO: 6377 - protein, 7 aa, Artificial Sequence
  Description of Artificial Sequence: Synthetic peptide
LGSNRAS

SEQ ID NO: 6378 - protein, 7 aa, Artificial Sequence
  Description of Artificial Sequence: Synthetic peptide
LGSNRAS

SEQ ID NO: 6379 - protein, 7 aa, Artificial Sequence
  Description of Artificial Sequence: Synthetic peptide
AASSLQS

SEQ ID NO: 6380 - protein, 7 aa, Artificial Sequence
  Description of Artificial Sequence: Synthetic peptide
AASSLQS

SEQ ID NO: 6381 - protein, 7 aa, Artificial Sequence
  Description of Artificial Sequence: Synthetic peptide
AASSLQS

SEQ ID NO: 6382 - protein, 7 aa, Artificial Sequence
  Description of Artificial Sequence: Synthetic peptide
AASSLQS

SEQ ID NO: 6383 - protein, 7 aa, Artificial Sequence
  Description of Artificial Sequence: Synthetic peptide
AASTLQS

SEQ ID NO: 6384 - protein, 7 aa, Artificial Sequence
  Description of Artificial Sequence: Synthetic peptide
AASTLQS

SEQ ID NO: 6385 - protein, 7 aa, Artificial Sequence
  Description of Artificial Sequence: Synthetic peptide
AASTLQS

SEQ ID NO: 6386 - protein, 7 aa, Artificial Sequence
  Description of Artificial Sequence: Synthetic peptide
TLSYRAS

SEQ ID NO: 6387 - protein, 7 aa, Artificial Sequence
  Description of Artificial Sequence: Synthetic peptide
LGSNRAS

SEQ ID NO: 6388 - protein, 7 aa, Artificial Sequence
  Description of Artificial Sequence: Synthetic peptide
LGSNRAS

SEQ ID NO: 6389 - protein, 7 aa, Artificial Sequence
  Description of Artificial Sequence: Synthetic peptide
STSNKHS

SEQ ID NO: 6390 - protein, 7 aa, Artificial Sequence
  Description of Artificial Sequence: Synthetic peptide
GTKFLAP

SEQ ID NO: 6391 - protein, 7 aa, Artificial Sequence
  Description of Artificial Sequence: Synthetic peptide
GTKFLAP

SEQ ID NO: 6392 - protein, 7 aa, Artificial Sequence
  Description of Artificial Sequence: Synthetic peptide
GTKFLAP

SEQ ID NO: 6393 - protein, 7 aa, Artificial Sequence
  Description of Artificial Sequence: Synthetic peptide
GTKFLAP

SEQ ID NO: 6394 - protein, 7 aa, Artificial Sequence
  Description of Artificial Sequence: Synthetic peptide
GTKFLAP

SEQ ID NO: 6395 - protein, 7 aa, Artificial Sequence
  Description of Artificial Sequence: Synthetic peptide
GTKFLAP

SEQ ID NO: 6396 - protein, 7 aa, Artificial Sequence
  Description of Artificial Sequence: Synthetic peptide
GTKFLAP

SEQ ID NO: 6397 - protein, 7 aa, Artificial Sequence
  Description of Artificial Sequence: Synthetic peptide
GTKFLAP

SEQ ID NO: 6398 - protein, 7 aa, Artificial Sequence
  Description of Artificial Sequence: Synthetic peptide
GTKFLAP

SEQ ID NO: 6399 - protein, 7 aa, Artificial Sequence
  Description of Artificial Sequence: Synthetic peptide
GTKFLAP

SEQ ID NO: 6400 - protein, 7 aa, Artificial Sequence
  Description of Artificial Sequence: Synthetic peptide
GTKFLAP

SEQ ID NO: 6401 - protein, 7 aa, Artificial Sequence
  Description of Artificial Sequence: Synthetic peptide
GTKFLAP

SEQ ID NO: 6402 - protein, 7 aa, Artificial Sequence
  Description of Artificial Sequence: Synthetic peptide
GTKFLAP

SEQ ID NO: 6403 - protein, 7 aa, Artificial Sequence
  Description of Artificial Sequence: Synthetic peptide
GTKFLAP

SEQ ID NO: 6404 - protein, 7 aa, Artificial Sequence
  Description of Artificial Sequence: Synthetic peptide
GTKFLAP

SEQ ID NO: 6405 - protein, 7 aa, Artificial Sequence
  Description of Artificial Sequence: Synthetic peptide
GTKFLAP

SEQ ID NO: 6406 - protein, 7 aa, Artificial Sequence
  Description of Artificial Sequence: Synthetic peptide
GTKFLAP

SEQ ID NO: 6407 - protein, 7 aa, Artificial Sequence
  Description of Artificial Sequence: Synthetic peptide
GTKFLAP

SEQ ID NO: 6408 - protein, 7 aa, Artificial Sequence
  Description of Artificial Sequence: Synthetic peptide
GTKFLAP

SEQ ID NO: 6409 - protein, 7 aa, Artificial Sequence
  Description of Artificial Sequence: Synthetic peptide
GTKFLAP

SEQ ID NO: 6410 - protein, 7 aa, Artificial Sequence
  Description of Artificial Sequence: Synthetic peptide
GTKFLAP

SEQ ID NO: 6411 - protein, 7 aa, Artificial Sequence
  Description of Artificial Sequence: Synthetic peptide
GTKFLAP

SEQ ID NO: 6412 - protein, 7 aa, Artificial Sequence
  Description of Artificial Sequence: Synthetic peptide
GTKFLAP

SEQ ID NO: 6413 - protein, 7 aa, Artificial Sequence
  Description of Artificial Sequence: Synthetic peptide
GTKFLAP

SEQ ID NO: 6414 - protein, 17 aa, Artificial Sequence
  Description of Artificial Sequence: Synthetic peptide
SISSSSSYIYYADSVKG

SEQ ID NO: 6415 - protein, 17 aa, Artificial Sequence
  Description of Artificial Sequence: Synthetic peptide
SISSSSSYIYYADSVKG

SEQ ID NO: 6416 - protein, 17 aa, Artificial Sequence
  Description of Artificial Sequence: Synthetic peptide
SISSSSSYIYYADSVKG

SEQ ID NO: 6417 - protein, 19 aa, Artificial Sequence
  Description of Artificial Sequence: Synthetic peptide
RIRSKANSYATAYAASVKG

SEQ ID NO: 6418 - protein, 19 aa, Artificial Sequence
  Description of Artificial Sequence: Synthetic peptide
RIRSKYNNYATYYADSVKD

SEQ ID NO: 6419 - protein, 19 aa, Artificial Sequence
  Description of Artificial Sequence: Synthetic peptide
RIRSKYNNYATYYADSVKD

SEQ ID NO: 6420 - protein, 19 aa, Artificial Sequence
  Description of Artificial Sequence: Synthetic peptide
RIRSKYNNYATYYADSVKD

SEQ ID NO: 6421 - protein, 19 aa, Artificial Sequence
  Description of Artificial Sequence: Synthetic peptide
RIRSKYNNYATYYADSVKD

SEQ ID NO: 6422 - protein, 19 aa, Artificial Sequence
  Description of Artificial Sequence: Synthetic peptide
RIRSKYNNYATYYADSVKD

SEQ ID NO: 6423 - protein, 19 aa, Artificial Sequence
  Description of Artificial Sequence: Synthetic peptide
RIRSKYNNYATYYADSVKD

SEQ ID NO: 6424 - protein, 19 aa, Artificial Sequence
  Description of Artificial Sequence: Synthetic peptide
RIRSKYNNYATYYADSVKD

SEQ ID NO: 6425 - protein, 19 aa, Artificial Sequence
  Description of Artificial Sequence: Synthetic peptide
RIRSKYNNYATYYADSVKD

SEQ ID NO: 6426 - protein, 19 aa, Artificial Sequence
  Description of Artificial Sequence: Synthetic peptide
RIRSKYNNYATYYADSVKD

SEQ ID NO: 6427 - protein, 19 aa, Artificial Sequence
  Description of Artificial Sequence: Synthetic peptide
RIRSKYNNYATYYADSVKD

SEQ ID NO: 6428 - protein, 19 aa, Artificial Sequence
  Description of Artificial Sequence: Synthetic peptide
RIRSKYNNYATYYADSVKD

SEQ ID NO: 6429 - protein, 19 aa, Artificial Sequence
  Description of Artificial Sequence: Synthetic peptide
RIRSKYNNYATYYADSVKD

SEQ ID NO: 6430 - protein, 19 aa, Artificial Sequence
  Description of Artificial Sequence: Synthetic peptide
RIRSKYNNYATYYADSVKD

SEQ ID NO: 6431 - protein, 19 aa, Artificial Sequence
  Description of Artificial Sequence: Synthetic peptide
RIRSKYNNYATYYADSVKD

SEQ ID NO: 6432 - protein, 19 aa, Artificial Sequence
  Description of Artificial Sequence: Synthetic peptide
RIRSKYNNYATYYADSVKD

SEQ ID NO: 6433 - protein, 19 aa, Artificial Sequence
  Description of Artificial Sequence: Synthetic peptide
RIRSKYNNYATYYADSVKD

SEQ ID NO: 6434 - protein, 19 aa, Artificial Sequence
  Description of Artificial Sequence: Synthetic peptide
RIRSKYNNYATYYADSVKD

SEQ ID NO: 6435 - protein, 19 aa, Artificial Sequence
  Description of Artificial Sequence: Synthetic peptide
RIRSKYNNYATYYADSVKD

SEQ ID NO: 6436 - protein, 19 aa, Artificial Sequence
  Description of Artificial Sequence: Synthetic peptide
RIRSKYNNYATYYADSVKD

SEQ ID NO: 6437 - protein, 19 aa, Artificial Sequence
  Description of Artificial Sequence: Synthetic peptide
RIRSKYNNYATYYADSVKD

SEQ ID NO: 6438 - protein, 19 aa, Artificial Sequence
  Description of Artificial Sequence: Synthetic peptide
RIRSKYNNYATYYADSVKD

SEQ ID NO: 6439 - protein, 19 aa, Artificial Sequence
  Description of Artificial Sequence: Synthetic peptide
RIRSKYNNYATYYADSVKD

SEQ ID NO: 6440 - protein, 19 aa, Artificial Sequence
  Description of Artificial Sequence: Synthetic peptide
RIRSKYNNYATYYADSVKD

SEQ ID NO: 6441 - protein, 19 aa, Artificial Sequence
  Description of Artificial Sequence: Synthetic peptide
RIRSKYNNYATYYADSVKD

SEQ ID NO: 6442 - protein, 17 aa, Artificial Sequence
  Description of Artificial Sequence: Synthetic peptide
AISGSGGSTYYADSVKG

SEQ ID NO: 6443 - protein, 17 aa, Artificial Sequence
  Description of Artificial Sequence: Synthetic peptide
AISGSGGSTYYADSVKG

SEQ ID NO: 6444 - protein, 17 aa, Artificial Sequence
  Description of Artificial Sequence: Synthetic peptide
AISGSGGSTYYADSVKG

SEQ ID NO: 6445 - protein, 17 aa, Artificial Sequence
  Description of Artificial Sequence: Synthetic peptide
AISGSGGSTYYADSVKG

SEQ ID NO: 6446 - protein, 17 aa, Artificial Sequence
  Description of Artificial Sequence: Synthetic peptide
AISGSGGSTYYADSVKG

SEQ ID NO: 6447 - protein, 17 aa, Artificial Sequence
  Description of Artificial Sequence: Synthetic peptide
GIIPIFGTANYAQKFQG

SEQ ID NO: 6448 - protein, 17 aa, Artificial Sequence
  Description of Artificial Sequence: Synthetic peptide
RIYPGDGDTNYNGKFKG

SEQ ID NO: 6449 - protein, 17 aa, Artificial Sequence
  Description of Artificial Sequence: Synthetic peptide
RIYPGDGDTNYNGKFKG

SEQ ID NO: 6450 - protein, 17 aa, Artificial Sequence
  Description of Artificial Sequence: Synthetic peptide
GIIPIFGTANYAQKFQG

SEQ ID NO: 6451 - protein, 17 aa, Artificial Sequence
  Description of Artificial Sequence: Synthetic peptide
RVWPGDGDTTYNEKFKG

SEQ ID NO: 6452 - protein, 17 aa, Artificial Sequence
  Description of Artificial Sequence: Synthetic peptide
RVWPGDGDTTYNEKFKG

SEQ ID NO: 6453 - protein, 17 aa, Artificial Sequence
  Description of Artificial Sequence: Synthetic peptide
GIIPIFGTANYAQKFQG

SEQ ID NO: 6454 - protein, 17 aa, Artificial Sequence
  Description of Artificial Sequence: Synthetic peptide
RIYPGDGDTNYNGKFKD

SEQ ID NO: 6455 - protein, 17 aa, Artificial Sequence
  Description of Artificial Sequence: Synthetic peptide
RIYPGDGDTNYNGKFKD

SEQ ID NO: 6456 - protein, 17 aa, Artificial Sequence
  Description of Artificial Sequence: Synthetic peptide
WMNPNSGNTGYAQKFQG

SEQ ID NO: 6457 - protein, 17 aa, Artificial Sequence
  Description of Artificial Sequence: Synthetic peptide
WMNPNSGNTGYAQKFQG

SEQ ID NO: 6458 - protein, 17 aa, Artificial Sequence
  Description of Artificial Sequence: Synthetic peptide
WMNPNSGNTGYAQKFQG

SEQ ID NO: 6459 - protein, 17 aa, Artificial Sequence
  Description of Artificial Sequence: Synthetic peptide
VISYDGSNKYYADSVKG

SEQ ID NO: 6460 - protein, 17 aa, Artificial Sequence
  Description of Artificial Sequence: Synthetic peptide
VISYDGGNKYYADSVKG

SEQ ID NO: 6461 - protein, 17 aa, Artificial Sequence
  Description of Artificial Sequence: Synthetic peptide
VISYDGGNKYYADSVKG

SEQ ID NO: 6462 - protein, 18 aa, Artificial Sequence
  Description of Artificial Sequence: Synthetic peptide
RTYYRSKWYNDYAVSVKS

SEQ ID NO: 6463 - protein, 18 aa, Artificial Sequence
  Description of Artificial Sequence: Synthetic peptide
RTYYRSKWYNDYAVSVKS

SEQ ID NO: 6464 - protein, 18 aa, Artificial Sequence
  Description of Artificial Sequence: Synthetic peptide
RTYYRSKWYNDYAVSVKS

SEQ ID NO: 6465 - protein, 16 aa, Artificial Sequence
  Description of Artificial Sequence: Synthetic peptide
EINHSGSTNYNPSLKS

SEQ ID NO: 6466 - protein, 16 aa, Artificial Sequence
  Description of Artificial Sequence: Synthetic peptide
EINHRGSTNYNPSLKS

SEQ ID NO: 6467 - protein, 16 aa, Artificial Sequence
  Description of Artificial Sequence: Synthetic peptide
EINHRGSTNYNPSLKS

SEQ ID NO: 6468 - protein, 17 aa, Artificial Sequence
  Description of Artificial Sequence: Synthetic peptide
WINPNSGGTNYAQKFQG

SEQ ID NO: 6469 - protein, 17 aa, Artificial Sequence
  Description of Artificial Sequence: Synthetic peptide
RINPNSGDTHYAQKFQG

SEQ ID NO: 6470 - protein, 17 aa, Artificial Sequence
  Description of Artificial Sequence: Synthetic peptide
RINPNSGDTHYAQKFQG

SEQ ID NO: 6471 - protein, 16 aa, Artificial Sequence
  Description of Artificial Sequence: Synthetic peptide
YIYYSGSTYYNPSLKS

SEQ ID NO: 6472 - protein, 16 aa, Artificial Sequence
  Description of Artificial Sequence: Synthetic peptide
YIYYSGSTYYNPSLKS

SEQ ID NO: 6473 - protein, 16 aa, Artificial Sequence
  Description of Artificial Sequence: Synthetic peptide
YIYYSGSTYYNPSLKS

SEQ ID NO: 6474 - protein, 32 aa, Artificial Sequence; identical to SEQ ID NO: 4211
  Description of Artificial Sequence: Synthetic polypeptide

SEQ ID NO: 6475 - protein, 32 aa, Artificial Sequence; identical to SEQ ID NO: 4211
  Description of Artificial Sequence: Synthetic polypeptide

SEQ ID NO: 6476 - protein, 32 aa, Artificial Sequence; identical to SEQ ID NO: 4211
  Description of Artificial Sequence: Synthetic polypeptide

SEQ ID NO: 6477 - protein, 32 aa, Artificial Sequence; identical to SEQ ID NO: 4211
  Description of Artificial Sequence: Synthetic polypeptide

SEQ ID NO: 6478 - protein, 32 aa, Artificial Sequence; identical to SEQ ID NO: 1369
  Description of Artificial Sequence: Synthetic polypeptide

SEQ ID NO: 6479 - protein, 32 aa, Artificial Sequence; identical to SEQ ID NO: 1346
  Description of Artificial Sequence: Synthetic polypeptide

SEQ ID NO: 6480 - protein, 32 aa, Artificial Sequence; identical to SEQ ID NO: 1346
  Description of Artificial Sequence: Synthetic polypeptide

SEQ ID NO: 6481 - protein, 32 aa, Artificial Sequence; identical to SEQ ID NO: 1367
  Description of Artificial Sequence: Synthetic polypeptide

SEQ ID NO: 6482 - protein, 32 aa, Artificial Sequence; identical to SEQ ID NO: 4214
  Description of Artificial Sequence: Synthetic polypeptide

SEQ ID NO: 6483 - protein, 32 aa, Artificial Sequence; identical to SEQ ID NO: 4214
  Description of Artificial Sequence: Synthetic polypeptide

SEQ ID NO: 6484 - protein, 32 aa, Artificial Sequence; identical to SEQ ID NO: 4215
  Description of Artificial Sequence: Synthetic polypeptide

SEQ ID NO: 6485 - protein, 32 aa, Artificial Sequence; identical to SEQ ID NO: 4216
  Description of Artificial Sequence: Synthetic polypeptide

SEQ ID NO: 6486 - protein, 32 aa, Artificial Sequence; identical to SEQ ID NO: 4216
  Description of Artificial Sequence: Synthetic polypeptide

SEQ ID NO: 6487 - protein, 32 aa, Artificial Sequence; identical to SEQ ID NO: 1346
  Description of Artificial Sequence: Synthetic polypeptide

SEQ ID NO: 6488 - protein, 32 aa, Artificial Sequence; identical to SEQ ID NO: 4218
  Description of Artificial Sequence: Synthetic polypeptide

SEQ ID NO: 6489 - protein, 32 aa, Artificial Sequence; identical to SEQ ID NO: 4218
  Description of Artificial Sequence: Synthetic polypeptide

SEQ ID NO: 6490 - protein, 32 aa, Artificial Sequence; identical to SEQ ID NO: 1372
  Description of Artificial Sequence: Synthetic polypeptide

SEQ ID NO: 6491 - protein, 32 aa, Artificial Sequence; identical to SEQ ID NO: 4220
  Description of Artificial Sequence: Synthetic polypeptide

SEQ ID NO: 6492 - protein, 32 aa, Artificial Sequence; identical to SEQ ID NO: 4220
  Description of Artificial Sequence: Synthetic polypeptide

SEQ ID NO: 6493 - protein, 32 aa, Artificial Sequence; identical to SEQ ID NO: 4211
  Description of Artificial Sequence: Synthetic polypeptide

SEQ ID NO: 6494 - protein, 32 aa, Artificial Sequence; identical to SEQ ID NO: 4211
  Description of Artificial Sequence: Synthetic polypeptide

SEQ ID NO: 6495 - protein, 32 aa, Artificial Sequence; identical to SEQ ID NO: 1372
  Description of Artificial Sequence: Synthetic polypeptide

SEQ ID NO: 6496 - protein, 32 aa, Artificial Sequence; identical to SEQ ID NO: 1372
  Description of Artificial Sequence: Synthetic polypeptide

SEQ ID NO: 6497 - protein, 32 aa, Artificial Sequence; identical to SEQ ID NO: 4220
  Description of Artificial Sequence: Synthetic polypeptide

SEQ ID NO: 6498 - protein, 32 aa, Artificial Sequence; identical to SEQ ID NO: 1372
  Description of Artificial Sequence: Synthetic polypeptide

SEQ ID NO: 6499 - protein, 32 aa, Artificial Sequence; identical to SEQ ID NO: 1372
  Description of Artificial Sequence: Synthetic polypeptide

SEQ ID NO: 6500 - protein, 32 aa, Artificial Sequence; identical to SEQ ID NO: 1372
  Description of Artificial Sequence: Synthetic polypeptide

SEQ ID NO: 6501 - protein, 32 aa, Artificial Sequence; identical to SEQ ID NO: 4220
  Description of Artificial Sequence: Synthetic polypeptide

SEQ ID NO: 6502 - protein, 32 aa, Artificial Sequence; identical to SEQ ID NO: 1346
  Description of Artificial Sequence: Synthetic polypeptide

SEQ ID NO: 6503 - protein, 32 aa, Artificial Sequence; identical to SEQ ID NO: 1346
  Description of Artificial Sequence: Synthetic polypeptide

SEQ ID NO: 6504 - protein, 32 aa, Artificial Sequence; identical to SEQ ID NO: 1346
  Description of Artificial Sequence: Synthetic polypeptide

SEQ ID NO: 6505 - protein, 32 aa, Artificial Sequence; identical to SEQ ID NO: 1346
  Description of Artificial Sequence: Synthetic polypeptide

SEQ ID NO: 6506 - protein, 32 aa, Artificial Sequence; identical to SEQ ID NO: 1369
  Description of Artificial Sequence: Synthetic polypeptide

SEQ ID NO: 6507 - protein, 32 aa, Artificial Sequence; identical to SEQ ID NO: 1369
  Description of Artificial Sequence: Synthetic polypeptide

SEQ ID NO: 6508 - protein, 32 aa, Artificial Sequence; identical to SEQ ID NO: 1369
  Description of Artificial Sequence: Synthetic polypeptide

SEQ ID NO: 6509 - protein, 32 aa, Artificial Sequence; identical to SEQ ID NO: 1372
  Description of Artificial Sequence: Synthetic polypeptide

SEQ ID NO: 6510 - protein, 32 aa, Artificial Sequence; identical to SEQ ID NO: 1372
  Description of Artificial Sequence: Synthetic polypeptide

SEQ ID NO: 6511 - protein, 32 aa, Artificial Sequence; identical to SEQ ID NO: 1372
  Description of Artificial Sequence: Synthetic polypeptide

SEQ ID NO: 6512 - protein, 32 aa, Artificial Sequence; identical to SEQ ID NO: 1385
  Description of Artificial Sequence: Synthetic polypeptide

SEQ ID NO: 6513 - protein, 32 aa, Artificial Sequence; identical to SEQ ID NO: 1386
  Description of Artificial Sequence: Synthetic polypeptide

SEQ ID NO: 6514 - protein, 32 aa, Artificial Sequence; identical to SEQ ID NO: 1386
  Description of Artificial Sequence: Synthetic polypeptide

SEQ ID NO: 6515 - protein, 32 aa, Artificial Sequence; identical to SEQ ID NO: 1386
  Description of Artificial Sequence: Synthetic polypeptide

SEQ ID NO: 6516 - protein, 32 aa, Artificial Sequence; identical to SEQ ID NO: 1386
  Description of Artificial Sequence: Synthetic polypeptide

SEQ ID NO: 6517 - protein, 32 aa, Artificial Sequence; identical to SEQ ID NO: 1386
  Description of Artificial Sequence: Synthetic polypeptide

SEQ ID NO: 6518 - protein, 32 aa, Artificial Sequence; identical to SEQ ID NO: 1386
  Description of Artificial Sequence: Synthetic polypeptide

SEQ ID NO: 6519 - protein, 32 aa, Artificial Sequence; identical to SEQ ID NO: 1386
  Description of Artificial Sequence: Synthetic polypeptide

SEQ ID NO: 6520 - protein, 32 aa, Artificial Sequence; identical to SEQ ID NO: 1386
  Description of Artificial Sequence: Synthetic polypeptide

SEQ ID NO: 6521 - protein, 32 aa, Artificial Sequence; identical to SEQ ID NO: 1386
  Description of Artificial Sequence: Synthetic polypeptide

SEQ ID NO: 6522 - protein, 32 aa, Artificial Sequence; identical to SEQ ID NO: 1386
  Description of Artificial Sequence: Synthetic polypeptide

SEQ ID NO: 6523 - protein, 32 aa, Artificial Sequence; identical to SEQ ID NO: 1386
  Description of Artificial Sequence: Synthetic polypeptide

SEQ ID NO: 6524 - protein, 32 aa, Artificial Sequence; identical to SEQ ID NO: 1386
  Description of Artificial Sequence: Synthetic polypeptide

SEQ ID NO: 6525 - protein, 32 aa, Artificial Sequence; identical to SEQ ID NO: 1386
  Description of Artificial Sequence: Synthetic polypeptide

SEQ ID NO: 6526 - protein, 32 aa, Artificial Sequence; identical to SEQ ID NO: 1386
  Description of Artificial Sequence: Synthetic polypeptide

SEQ ID NO: 6527 - protein, 32 aa, Artificial Sequence; identical to SEQ ID NO: 1386
  Description of Artificial Sequence: Synthetic polypeptide

SEQ ID NO: 6528 - protein, 32 aa, Artificial Sequence; identical to SEQ ID NO: 1386
  Description of Artificial Sequence: Synthetic polypeptide

SEQ ID NO: 6529 - protein, 32 aa, Artificial Sequence; identical to SEQ ID NO: 1386
  Description of Artificial Sequence: Synthetic polypeptide

SEQ ID NO: 6530 - protein, 32 aa, Artificial Sequence; identical to SEQ ID NO: 1386
  Description of Artificial Sequence: Synthetic polypeptide

SEQ ID NO: 6531 - protein, 32 aa, Artificial Sequence; identical to SEQ ID NO: 1386
  Description of Artificial Sequence: Synthetic polypeptide

SEQ ID NO: 6532 - protein, 32 aa, Artificial Sequence; identical to SEQ ID NO: 1386
  Description of Artificial Sequence: Synthetic polypeptide

SEQ ID NO: 6533 - protein, 32 aa, Artificial Sequence; identical to SEQ ID NO: 1386
  Description of Artificial Sequence: Synthetic polypeptide

SEQ ID NO: 6534 - protein, 32 aa, Artificial Sequence; identical to SEQ ID NO: 1386
  Description of Artificial Sequence: Synthetic polypeptide

SEQ ID NO: 6535 - protein, 32 aa, Artificial Sequence; identical to SEQ ID NO: 1386
  Description of Artificial Sequence: Synthetic polypeptide

SEQ ID NO: 6536 - protein, 32 aa, Artificial Sequence; identical to SEQ ID NO: 1386
  Description of Artificial Sequence: Synthetic polypeptide

SEQ ID NO: 6537 - protein, 32 aa, Artificial Sequence; identical to SEQ ID NO: 1504
  Description of Artificial Sequence: Synthetic polypeptide

SEQ ID NO: 6538 - protein, 32 aa, Artificial Sequence; identical to SEQ ID NO: 4237
  Description of Artificial Sequence: Synthetic polypeptide

SEQ ID NO: 6539 - protein, 32 aa, Artificial Sequence; identical to SEQ ID NO: 4237
  Description of Artificial Sequence: Synthetic polypeptide

SEQ ID NO: 6540 - protein, 32 aa, Artificial Sequence; identical to SEQ ID NO: 1441
  Description of Artificial Sequence: Synthetic polypeptide

SEQ ID NO: 6541 - protein, 32 aa, Artificial Sequence; identical to SEQ ID NO: 1442
  Description of Artificial Sequence: Synthetic polypeptide

SEQ ID NO: 6542 - protein, 32 aa, Artificial Sequence; identical to SEQ ID NO: 1442
  Description of Artificial Sequence: Synthetic polypeptide

SEQ ID NO: 6543 - protein, 32 aa, Artificial Sequence; identical to SEQ ID NO: 1442
  Description of Artificial Sequence: Synthetic polypeptide

SEQ ID NO: 6544 - protein, 32 aa, Artificial Sequence; identical to SEQ ID NO: 1442
  Description of Artificial Sequence: Synthetic polypeptide

SEQ ID NO: 6545 - protein, 32 aa, Artificial Sequence; identical to SEQ ID NO: 1442
  Description of Artificial Sequence: Synthetic polypeptide

SEQ ID NO: 6546 - protein, 32 aa, Artificial Sequence; identical to SEQ ID NO: 1442
  Description of Artificial Sequence: Synthetic polypeptide

SEQ ID NO: 6547 - protein, 32 aa, Artificial Sequence; identical to SEQ ID NO: 1442
  Description of Artificial Sequence: Synthetic polypeptide

SEQ ID NO: 6548 - protein, 32 aa, Artificial Sequence; identical to SEQ ID NO: 1442
  Description of Artificial Sequence: Synthetic polypeptide

SEQ ID NO: 6549 - protein, 32 aa, Artificial Sequence; identical to SEQ ID NO: 1442
  Description of Artificial Sequence: Synthetic polypeptide

SEQ ID NO: 6550 - protein, 32 aa, Artificial Sequence; identical to SEQ ID NO: 1442
  Description of Artificial Sequence: Synthetic polypeptide

SEQ ID NO: 6551 - protein, 32 aa, Artificial Sequence; identical to SEQ ID NO: 1442
  Description of Artificial Sequence: Synthetic polypeptide

SEQ ID NO: 6552 - protein, 32 aa, Artificial Sequence; identical to SEQ ID NO: 1442
  Description of Artificial Sequence: Synthetic polypeptide

SEQ ID NO: 6553 - protein, 32 aa, Artificial Sequence; identical to SEQ ID NO: 1442
  Description of Artificial Sequence: Synthetic polypeptide

SEQ ID NO: 6554 - protein, 32 aa, Artificial Sequence; identical to SEQ ID NO: 1442
  Description of Artificial Sequence: Synthetic polypeptide

SEQ ID NO: 6555 - protein, 32 aa, Artificial Sequence; identical to SEQ ID NO: 1442
  Description of Artificial Sequence: Synthetic polypeptide

SEQ ID NO: 6556 - protein, 32 aa, Artificial Sequence; identical to SEQ ID NO: 1442
  Description of Artificial Sequence: Synthetic polypeptide

SEQ ID NO: 6557 - protein, 32 aa, Artificial Sequence; identical to SEQ ID NO: 1442
  Description of Artificial Sequence: Synthetic polypeptide

SEQ ID NO: 6558 - protein, 32 aa, Artificial Sequence; identical to SEQ ID NO: 1442
  Description of Artificial Sequence: Synthetic polypeptide

SEQ ID NO: 6559 - protein, 32 aa, Artificial Sequence; identical to SEQ ID NO: 1442
  Description of Artificial Sequence: Synthetic polypeptide

SEQ ID NO: 6560 - protein, 32 aa, Artificial Sequence; identical to SEQ ID NO: 1442
  Description of Artificial Sequence: Synthetic polypeptide

SEQ ID NO: 6561 - protein, 32 aa, Artificial Sequence; identical to SEQ ID NO: 1442
  Description of Artificial Sequence: Synthetic polypeptide

SEQ ID NO: 6562 - protein, 32 aa, Artificial Sequence; identical to SEQ ID NO: 1442
  Description of Artificial Sequence: Synthetic polypeptide

SEQ ID NO: 6563 - protein, 32 aa, Artificial Sequence; identical to SEQ ID NO: 1442
  Description of Artificial Sequence: Synthetic polypeptide

SEQ ID NO: 6564 - protein, 32 aa, Artificial Sequence; identical to SEQ ID NO: 1442
  Description of Artificial Sequence: Synthetic polypeptide

SEQ ID NO: 6565 - protein, 32 aa, Artificial Sequence; identical to SEQ ID NO: 1427
  Description of Artificial Sequence: Synthetic polypeptide

SEQ ID NO: 6566 - protein, 32 aa, Artificial Sequence; identical to SEQ ID NO: 5703
  Description of Artificial Sequence: Synthetic polypeptide

SEQ ID NO: 6567 - protein, 32 aa, Artificial Sequence; identical to SEQ ID NO: 5703
  Description of Artificial Sequence: Synthetic polypeptide

SEQ ID NO: 6568 - protein, 32 aa, Artificial Sequence; identical to SEQ ID NO: 5703
  Description of Artificial Sequence: Synthetic polypeptide

SEQ ID NO: 6569 - protein, 32 aa, Artificial Sequence; identical to SEQ ID NO: 5703
  Description of Artificial Sequence: Synthetic polypeptide

SEQ ID NO: 6570 - protein, 32 aa, Artificial Sequence; identical to SEQ ID NO: 4249
  Description of Artificial Sequence: Synthetic polypeptide

SEQ ID NO: 6571 - protein, 32 aa, Artificial Sequence; identical to SEQ ID NO: 4250
  Description of Artificial Sequence: Synthetic polypeptide

SEQ ID NO: 6572 - protein, 32 aa, Artificial Sequence; identical to SEQ ID NO: 4250
  Description of Artificial Sequence: Synthetic polypeptide

SEQ ID NO: 6573 - protein, 32 aa, Artificial Sequence; identical to SEQ ID NO: 4249
  Description of Artificial Sequence: Synthetic polypeptide

SEQ ID NO: 6574 - protein, 32 aa, Artificial Sequence; identical to SEQ ID NO: 4252
  Description of Artificial Sequence: Synthetic polypeptide

SEQ ID NO: 6575 - protein, 32 aa, Artificial Sequence; identical to SEQ ID NO: 4252
  Description of Artificial Sequence: Synthetic polypeptide

SEQ ID NO: 6576 - protein, 32 aa, Artificial Sequence; identical to SEQ ID NO: 4249
  Description of Artificial Sequence: Synthetic polypeptide

SEQ ID NO: 6577 - protein, 32 aa, Artificial Sequence; identical to SEQ ID NO: 4254
  Description of Artificial Sequence: Synthetic polypeptide

SEQ ID NO: 6578 - protein, 32 aa, Artificial Sequence; identical to SEQ ID NO: 4254
  Description of Artificial Sequence: Synthetic polypeptide

SEQ ID NO: 6579 - protein, 32 aa, Artificial Sequence; identical to SEQ ID NO: 4255
  Description of Artificial Sequence: Synthetic polypeptide

SEQ ID NO: 6580 - protein, 32 aa, Artificial Sequence; identical to SEQ ID NO: 4255
  Description of Artificial Sequence: Synthetic polypeptide

SEQ ID NO: 6581 - protein, 32 aa, Artificial Sequence; identical to SEQ ID NO: 4255
  Description of Artificial Sequence: Synthetic polypeptide

SEQ ID NO: 6582 - protein, 32 aa, Artificial Sequence; identical to SEQ ID NO: 1501
  Description of Artificial Sequence: Synthetic polypeptide

SEQ ID NO: 6583 - protein, 32 aa, Artificial Sequence; identical to SEQ ID NO: 1501
  Description of Artificial Sequence: Synthetic polypeptide

SEQ ID NO: 6584 - protein, 32 aa, Artificial Sequence; identical to SEQ ID NO: 1501
  Description of Artificial Sequence: Synthetic polypeptide

SEQ ID NO: 6585 - protein, 32 aa, Artificial Sequence; identical to SEQ ID NO: 5722
  Description of Artificial Sequence: Synthetic polypeptide

SEQ ID NO: 6586 - protein, 32 aa, Artificial Sequence; identical to SEQ ID NO: 5723
  Description of Artificial Sequence: Synthetic polypeptide

SEQ ID NO: 6587 - protein, 32 aa, Artificial Sequence; identical to SEQ ID NO: 5723
  Description of Artificial Sequence: Synthetic polypeptide

SEQ ID NO: 6588 - protein, 32 aa, Artificial Sequence; identical to SEQ ID NO: 1499
  Description of Artificial Sequence: Synthetic polypeptide

SEQ ID NO: 6589 - protein, 32 aa, Artificial Sequence; identical to SEQ ID NO: 5726
  Description of Artificial Sequence: Synthetic polypeptide

SEQ ID NO: 6590 - protein, 32 aa, Artificial Sequence; identical to SEQ ID NO: 5726
  Description of Artificial Sequence: Synthetic polypeptide

SEQ ID NO: 6591 - protein, 32 aa, Artificial Sequence; identical to SEQ ID NO: 5728
  Description of Artificial Sequence: Synthetic polypeptide

SEQ ID NO: 6592 - protein, 32 aa, Artificial Sequence; identical to SEQ ID NO: 5728
  Description of Artificial Sequence: Synthetic polypeptide

SEQ ID NO: 6593 - protein, 32 aa, Artificial Sequence; identical to SEQ ID NO: 5728
  Description of Artificial Sequence: Synthetic polypeptide

SEQ ID NO: 6594 - protein, 32 aa, Artificial Sequence; identical to SEQ ID NO: 1499
  Description of Artificial Sequence: Synthetic polypeptide

SEQ ID NO: 6595 - protein, 32 aa, Artificial Sequence; identical to SEQ ID NO: 1499
  Description of Artificial Sequence: Synthetic polypeptide

SEQ ID NO: 6596 - protein, 32 aa, Artificial Sequence; identical to SEQ ID NO: 1499
  Description of Artificial Sequence: Synthetic polypeptide

SEQ ID NO: 6597 - protein, 9 aa, Artificial Sequence
  Description of Artificial Sequence: Synthetic peptide
QQYGSSPLT

SEQ ID NO: 6598 - protein, 9 aa, Artificial Sequence
  Description of Artificial Sequence: Synthetic peptide
QQYANSPLT

SEQ ID NO: 6599 - protein, 9 aa, Artificial Sequence
  Description of Artificial Sequence: Synthetic peptide
QQYANSPLT

SEQ ID NO: 6600 - protein, 9 aa, Artificial Sequence
  Description of Artificial Sequence: Synthetic peptide
QQYGSSPLT

SEQ ID NO: 6601 - protein, 9 aa, Artificial Sequence
  Description of Artificial Sequence: Synthetic peptide
QKYNSAPWT

SEQ ID NO: 6602 - protein, 9 aa, Artificial Sequence
  Description of Artificial Sequence: Synthetic peptide
QQSYSTPPT

SEQ ID NO: 6603 - protein, 9 aa, Artificial Sequence
  Description of Artificial Sequence: Synthetic peptide
QQSYSTPPT

SEQ ID NO: 6604 - protein, 9 aa, Artificial Sequence
  Description of Artificial Sequence: Synthetic peptide
QQYYSTPYT

SEQ ID NO: 6605 - protein, 9 aa, Artificial Sequence
  Description of Artificial Sequence: Synthetic peptide
QQYYSYPYT

SEQ ID NO: 6606 - protein, 9 aa, Artificial Sequence
  Description of Artificial Sequence: Synthetic peptide
QQYYSYPYT

SEQ ID NO: 6607 - protein, 9 aa, Artificial Sequence
  Description of Artificial Sequence: Synthetic peptide
HQSSSLPYT

SEQ ID NO: 6608 - protein, 9 aa, Artificial Sequence
  Description of Artificial Sequence: Synthetic peptide
HQWSSYPPT

SEQ ID NO: 6609 - protein, 9 aa, Artificial Sequence
  Description of Artificial Sequence: Synthetic peptide
HQWSSYPPT

SEQ ID NO: 6610 - protein, 9 aa, Artificial Sequence
  Description of Artificial Sequence: Synthetic peptide
LQDYNYPYT

SEQ ID NO: 6611 - protein, 9 aa, Artificial Sequence
  Description of Artificial Sequence: Synthetic peptide
QHHYGTPLT

SEQ ID NO: 6612 - protein, 9 aa, Artificial Sequence
  Description of Artificial Sequence: Synthetic peptide
QHHYGTPLT

SEQ ID NO: 6613 - protein, 9 aa, Artificial Sequence
  Description of Artificial Sequence: Synthetic peptide
MQALQTPIT

SEQ ID NO: 6614 - protein, 9 aa, Artificial Sequence
  Description of Artificial Sequence: Synthetic peptide
MQALQTPPT

SEQ ID NO: 6615 - protein, 9 aa, Artificial Sequence
  Description of Artificial Sequence: Synthetic peptide
MQALQTPPT

SEQ ID NO: 6616 - protein, 9 aa, Artificial Sequence
  Description of Artificial Sequence: Synthetic peptide
QQYGSSPYT

SEQ ID NO: 6617 - protein, 9 aa, Artificial Sequence
  Description of Artificial Sequence: Synthetic peptide
QQYGSSPLT

SEQ ID NO: 6618 - protein, 9 aa, Artificial Sequence
  Description of Artificial Sequence: Synthetic peptide
MQALQTPFT

SEQ ID NO: 6619 - protein, 9 aa, Artificial Sequence
  Description of Artificial Sequence: Synthetic peptide
MQALQTPLT

SEQ ID NO: 6620 - protein, 9 aa, Artificial Sequence
  Description of Artificial Sequence: Synthetic peptide
MQALQTPFT

SEQ ID NO: 6621 - protein, 9 aa, Artificial Sequence
  Description of Artificial Sequence: Synthetic peptide
MQALQTPLT

SEQ ID NO: 6622 - protein, 9 aa, Artificial Sequence
  Description of Artificial Sequence: Synthetic peptide
MQALQTPLT

SEQ ID NO: 6623 - protein, 9 aa, Artificial Sequence
  Description of Artificial Sequence: Synthetic peptide
MQALQTPWT

SEQ ID NO: 6624 - protein, 9 aa, Artificial Sequence
  Description of Artificial Sequence: Synthetic peptide
MQALQTPFT

SEQ ID NO: 6625 - protein, 9 aa, Artificial Sequence
  Description of Artificial Sequence: Synthetic peptide
QQANSFPFT

SEQ ID NO: 6626 - protein, 9 aa, Artificial Sequence
  Description of Artificial Sequence: Synthetic peptide
QQSYRTPPT

SEQ ID NO: 6627 - protein, 9 aa, Artificial Sequence
  Description of Artificial Sequence: Synthetic peptide
QQANSFPWT

SEQ ID NO: 6628 - protein, 9 aa, Artificial Sequence
  Description of Artificial Sequence: Synthetic peptide
QQSYRTPPT

SEQ ID NO: 6629 - protein, 9 aa, Artificial Sequence
  Description of Artificial Sequence: Synthetic peptide
QKYNSAPYT

SEQ ID NO: 6630 - protein, 9 aa, Artificial Sequence
  Description of Artificial Sequence: Synthetic peptide
QKYNSAPWT

SEQ ID NO: 6631 - protein, 9 aa, Artificial Sequence
  Description of Artificial Sequence: Synthetic peptide
QKYNSAPWT

SEQ ID NO: 6632 - protein, 9 aa, Artificial Sequence
  Description of Artificial Sequence: Synthetic peptide
MQRIEFPIT

SEQ ID NO: 6633 - protein, 9 aa, Artificial Sequence
  Description of Artificial Sequence: Synthetic peptide
MQALQTPIT

SEQ ID NO: 6634 - protein, 9 aa, Artificial Sequence
  Description of Artificial Sequence: Synthetic peptide
MQALQTPIT

SEQ ID NO: 6635 - protein, 10 aa, Artificial Sequence
  Description of Artificial Sequence: Synthetic peptide
LLYYGGAQWV

SEQ ID NO: 6636 - protein, 9 aa, Artificial Sequence
  Description of Artificial Sequence: Synthetic peptide
VLWYSNRWV

SEQ ID NO: 6637 - protein, 9 aa, Artificial Sequence
  Description of Artificial Sequence: Synthetic peptide
VLWYSNRWV

SEQ ID NO: 6638 - protein, 9 aa, Artificial Sequence
  Description of Artificial Sequence: Synthetic peptide
VLWYSNRWV

SEQ ID NO: 6639 - protein, 9 aa, Artificial Sequence
  Description of Artificial Sequence: Synthetic peptide
VLWYSNRWV

SEQ ID NO: 6640 - protein, 9 aa, Artificial Sequence
  Description of Artificial Sequence: Synthetic peptide
VLWYSNRWV

SEQ ID NO: 6641 - protein, 9 aa, Artificial Sequence
  Description of Artificial Sequence: Synthetic peptide
VLWYSNRWV

SEQ ID NO: 6642 - protein, 9 aa, Artificial Sequence
  Description of Artificial Sequence: Synthetic peptide
VLWYSNRWV

SEQ ID NO: 6643 - protein, 9 aa, Artificial Sequence
  Description of Artificial Sequence: Synthetic peptide
VLWYSNRWV

SEQ ID NO: 6644 - protein, 9 aa, Artificial Sequence
  Description of Artificial Sequence: Synthetic peptide
VLWYSNRWV

SEQ ID NO: 6645 - protein, 9 aa, Artificial Sequence
  Description of Artificial Sequence: Synthetic peptide
VLWYSNRWV

SEQ ID NO: 6646 - protein, 9 aa, Artificial Sequence
  Description of Artificial Sequence: Synthetic peptide
VLWYSNRWV

SEQ ID NO: 6647 - protein, 9 aa, Artificial Sequence
  Description of Artificial Sequence: Synthetic peptide
VLWYSNRWV

SEQ ID NO: 6648 - protein, 9 aa, Artificial Sequence
  Description of Artificial Sequence: Synthetic peptide
VLWYSNRWV

SEQ ID NO: 6649 - protein, 9 aa, Artificial Sequence
  Description of Artificial Sequence: Synthetic peptide
VLWYSNRWV

SEQ ID NO: 6650 - protein, 9 aa, Artificial Sequence
  Description of Artificial Sequence: Synthetic peptide
VLWYSNRWV

SEQ ID NO: 6651 - protein, 9 aa, Artificial Sequence
  Description of Artificial Sequence: Synthetic peptide
VLWYSNRWV

SEQ ID NO: 6652 - protein, 9 aa, Artificial Sequence
  Description of Artificial Sequence: Synthetic peptide
VLWYSNRWV

SEQ ID NO: 6653 - protein, 9 aa, Artificial Sequence
  Description of Artificial Sequence: Synthetic peptide
VLWYSNRWV

SEQ ID NO: 6654 - protein, 9 aa, Artificial Sequence
  Description of Artificial Sequence: Synthetic peptide
VLWYSNRWV

SEQ ID NO: 6655 - protein, 9 aa, Artificial Sequence
  Description of Artificial Sequence: Synthetic peptide
VLWYSNRWV

SEQ ID NO: 6656 - protein, 9 aa, Artificial Sequence
  Description of Artificial Sequence: Synthetic peptide
VLWYSNRWV

SEQ ID NO: 6657 - protein, 9 aa, Artificial Sequence
  Description of Artificial Sequence: Synthetic peptide
VLWYSNRWV

SEQ ID NO: 6658 - protein, 9 aa, Artificial Sequence
  Description of Artificial Sequence: Synthetic peptide
VLWYSNRWV

SEQ ID NO: 6659 - protein, 9 aa, Artificial Sequence
  Description of Artificial Sequence: Synthetic peptide
VLWYSNRWV

SEQ ID NO: 6660 - protein, 15 aa, Artificial Sequence
  Description of Artificial Sequence: Synthetic peptide
DIVVVVAATAEYFQH

SEQ ID NO: 6661 - protein, 11 aa, Artificial Sequence
  Description of Artificial Sequence: Synthetic peptide
DRIAVATYFDN

SEQ ID NO: 6662 - protein, 11 aa, Artificial Sequence
  Description of Artificial Sequence: Synthetic peptide
DRIAVATYFDN

SEQ ID NO: 6663 - protein, 13 aa, Artificial Sequence
  Description of Artificial Sequence: Synthetic peptide
ITIFGVVIIYFDY

SEQ ID NO: 6664 - protein, 14 aa, Artificial Sequence
  Description of Artificial Sequence: Synthetic peptide
HGNFGNSYISYWAY

SEQ ID NO: 6665 - protein, 14 aa, Artificial Sequence
  Description of Artificial Sequence: Synthetic peptide
HGNFGNSYISYWAY

SEQ ID NO: 6666 - protein, 14 aa, Artificial Sequence
  Description of Artificial Sequence: Synthetic peptide
HGNFGNSYISYWAY

SEQ ID NO: 6667 - protein, 14 aa, Artificial Sequence
  Description of Artificial Sequence: Synthetic peptide
HGNFGNSYISYWAY

SEQ ID NO: 6668 - protein, 14 aa, Artificial Sequence
  Description of Artificial Sequence: Synthetic peptide
HGNFGNSYISYWAY

SEQ ID NO: 6669 - protein, 14 aa, Artificial Sequence
  Description of Artificial Sequence: Synthetic peptide
HGNFGNSYISYWAY

SEQ ID NO: 6670 - protein, 14 aa, Artificial Sequence
  Description of Artificial Sequence: Synthetic peptide
HGNFGNSYISYWAY

SEQ ID NO: 6671 - protein, 14 aa, Artificial Sequence
  Description of Artificial Sequence: Synthetic peptide
HGNFGNSYISYWAY

SEQ ID NO: 6672 - protein, 14 aa, Artificial Sequence
  Description of Artificial Sequence: Synthetic peptide
HGNFGNSYISYWAY

SEQ ID NO: 6673 - protein, 14 aa, Artificial Sequence
  Description of Artificial Sequence: Synthetic peptide
HGNFGNSYISYWAY

SEQ ID NO: 6674 - protein, 14 aa, Artificial Sequence
  Description of Artificial Sequence: Synthetic peptide
HGNFGNSYISYWAY

SEQ ID NO: 6675 - protein, 14 aa, Artificial Sequence
  Description of Artificial Sequence: Synthetic peptide
HGNFGNSYISYWAY

SEQ ID NO: 6676 - protein, 14 aa, Artificial Sequence
  Description of Artificial Sequence: Synthetic peptide
HGNFGNSYISYWAY

SEQ ID NO: 6677 - protein, 14 aa, Artificial Sequence
  Description of Artificial Sequence: Synthetic peptide
HGNFGNSYISYWAY

SEQ ID NO: 6678 - protein, 14 aa, Artificial Sequence
  Description of Artificial Sequence: Synthetic peptide
HGNFGNSYISYWAY

SEQ ID NO: 6679 - protein, 14 aa, Artificial Sequence
  Description of Artificial Sequence: Synthetic peptide
HGNFGNSYISYWAY

SEQ ID NO: 6680 - protein, 14 aa, Artificial Sequence
  Description of Artificial Sequence: Synthetic peptide
HGNFGNSYISYWAY

SEQ ID NO: 6681 - protein, 14 aa, Artificial Sequence
  Description of Artificial Sequence: Synthetic peptide
HGNFGNSYISYWAY

SEQ ID NO: 6682 - protein, 14 aa, Artificial Sequence
  Description of Artificial Sequence: Synthetic peptide
HGNFGNSYISYWAY

SEQ ID NO: 6683 - protein, 14 aa, Artificial Sequence
  Description of Artificial Sequence: Synthetic peptide
HGNFGNSYISYWAY

SEQ ID NO: 6684 - protein, 14 aa, Artificial Sequence
  Description of Artificial Sequence: Synthetic peptide
HGNFGNSYISYWAY

SEQ ID NO: 6685 - protein, 14 aa, Artificial Sequence
  Description of Artificial Sequence: Synthetic peptide
HGNFGNSYISYWAY

SEQ ID NO: 6686 - protein, 14 aa, Artificial Sequence
  Description of Artificial Sequence: Synthetic peptide
HGNFGNSYISYWAY

SEQ ID NO: 6687 - protein, 14 aa, Artificial Sequence
  Description of Artificial Sequence: Synthetic peptide
HGNFGNSYISYWAY

SEQ ID NO: 6688 - protein, 14 aa, Artificial Sequence
  Description of Artificial Sequence: Synthetic peptide
GTTGTYYYYYGMDV

SEQ ID NO: 6689 - protein, 12 aa, Artificial Sequence
  Description of Artificial Sequence: Synthetic peptide
MVTPDYYYDMDV

SEQ ID NO: 6690 - protein, 12 aa, Artificial Sequence
  Description of Artificial Sequence: Synthetic peptide
MVTPDYYYDMDV

SEQ ID NO: 6691 - protein, 12 aa, Artificial Sequence
  Description of Artificial Sequence: Synthetic peptide
MVTPDYYYDMDV

SEQ ID NO: 6692 - protein, 12 aa, Artificial Sequence
  Description of Artificial Sequence: Synthetic peptide
MVTPDYYYDMDV

SEQ ID NO: 6693 - protein, 13 aa, Artificial Sequence
  Description of Artificial Sequence: Synthetic peptide
DIVVVVAATYFDY

SEQ ID NO: 6694 - protein, 10 aa, Artificial Sequence
  Description of Artificial Sequence: Synthetic peptide
DGVFYAPLAY

SEQ ID NO: 6695 - protein, 10 aa, Artificial Sequence
  Description of Artificial Sequence: Synthetic peptide
DGVFYAPLAY

SEQ ID NO: 6696 - protein, 10 aa, Artificial Sequence
  Description of Artificial Sequence: Synthetic peptide
GYSYGYYFDY

SEQ ID NO: 6697 - protein, 13 aa, Artificial Sequence
  Description of Artificial Sequence: Synthetic peptide
GNYFGSSEAYFDY

SEQ ID NO: 6698 - protein, 13 aa, Artificial Sequence
  Description of Artificial Sequence: Synthetic peptide
GNYFGSSEAYFDY

SEQ ID NO: 6699 - protein, 10 aa, Artificial Sequence
  Description of Artificial Sequence: Synthetic peptide
VQLERDAFDI

SEQ ID NO: 6700 - protein, 11 aa, Artificial Sequence
  Description of Artificial Sequence: Synthetic peptide
RQLNHVFAMDY

SEQ ID NO: 6701 - protein, 11 aa, Artificial Sequence
  Description of Artificial Sequence: Synthetic peptide
RQLNHVFAMDY

SEQ ID NO: 6702 - protein, 15 aa, Artificial Sequence
  Description of Artificial Sequence: Synthetic peptide
GYSYGYYYYYYGMDV

SEQ ID NO: 6703 - protein, 14 aa, Artificial Sequence
  Description of Artificial Sequence: Synthetic peptide
GGGYSNGYDYGMDV

SEQ ID NO: 6704 - protein, 14 aa, Artificial Sequence
  Description of Artificial Sequence: Synthetic peptide
GGGYSNGYDYGMDV

SEQ ID NO: 6705 - protein, 14 aa, Artificial Sequence
  Description of Artificial Sequence: Synthetic peptide
VQLERYYYYYGMDV

SEQ ID NO: 6706 - protein, 12 aa, Artificial Sequence
  Description of Artificial Sequence: Synthetic peptide
EQWPNYYYGMDV

SEQ ID NO: 6707 - protein, 12 aa, Artificial Sequence
  Description of Artificial Sequence: Synthetic peptide
EQWPNYYYGMDV

SEQ ID NO: 6708 - protein, 9 aa, Artificial Sequence
  Description of Artificial Sequence: Synthetic peptide
VLLWFGELL

SEQ ID NO: 6709 - protein, 9 aa, Artificial Sequence
  Description of Artificial Sequence: Synthetic peptide
YYYYYGMDV

SEQ ID NO: 6710 - protein, 16 aa, Artificial Sequence
  Description of Artificial Sequence: Synthetic peptide
EILWFGKLNYYYGMDV

SEQ ID NO: 6711 - protein, 16 aa, Artificial Sequence
  Description of Artificial Sequence: Synthetic peptide
EILWFGKLNYYYGMDV

SEQ ID NO: 6712 - protein, 15 aa, Artificial Sequence
  Description of Artificial Sequence: Synthetic peptide
GYSYGYYYYYYGMDV

SEQ ID NO: 6713 - protein, 14 aa, Artificial Sequence
  Description of Artificial Sequence: Synthetic peptide
GGGYSDGYDYGMDV

SEQ ID NO: 6714 - protein, 14 aa, Artificial Sequence
  Description of Artificial Sequence: Synthetic peptide
GGGYSDGYDYGMDV

SEQ ID NO: 6715 - protein, 6 aa, Artificial Sequence
  Description of Artificial Sequence: Synthetic peptide
LGYFDY

SEQ ID NO: 6716 - protein, 9 aa, Artificial Sequence
  Description of Artificial Sequence: Synthetic peptide
GLGISFFDY

SEQ ID NO: 6717 - protein, 9 aa, Artificial Sequence
  Description of Artificial Sequence: Synthetic peptide
GLGISFFDY

SEQ ID NO: 6718 - protein, 9 aa, Artificial Sequence
  Description of Artificial Sequence: Synthetic peptide
VLLWFGELL

SEQ ID NO: 6719 - protein, 9 aa, Artificial Sequence
  Description of Artificial Sequence: Synthetic peptide
YYYYYGMDV

SEQ ID NO: 6720 - protein, 16 aa, Artificial Sequence
  Description of Artificial Sequence: Synthetic peptide
DKLWFGKLNYYYGMDV

SEQ ID NO: 6721 - protein, 16 aa, Artificial Sequence
  Description of Artificial Sequence: Synthetic peptide
DKLWFGKLNYYYGMDV

SEQ ID NO: 6722 - protein, 10 aa, Artificial Sequence
  Description of Artificial Sequence: Synthetic peptide
FGGGTKVEIK

SEQ ID NO: 6723 - protein, 10 aa, Artificial Sequence
  Description of Artificial Sequence: Synthetic peptide
FGCGTKVEIK

SEQ ID NO: 6724 - protein, 10 aa, Artificial Sequence
  Description of Artificial Sequence: Synthetic peptide
FGGGTKVEIK

SEQ ID NO: 6725 - protein, 10 aa, Artificial Sequence
  Description of Artificial Sequence: Synthetic peptide
FGGGTKLEIK

SEQ ID NO: 6726 - protein, 10 aa, Artificial Sequence
  Description of Artificial Sequence: Synthetic peptide
FGQGTKVEIK

SEQ ID NO: 6727 - protein, 10 aa, Artificial Sequence
  Description of Artificial Sequence: Synthetic peptide
FGCGTKVEIK

SEQ ID NO: 6728 - protein, 10 aa, Artificial Sequence
  Description of Artificial Sequence: Synthetic peptide
FGQGTKVEIK

SEQ ID NO: 6729 - protein, 10 aa, Artificial Sequence
  Description of Artificial Sequence: Synthetic peptide
FGQGTKLEIK

SEQ ID NO: 6730 - protein, 10 aa, Artificial Sequence
  Description of Artificial Sequence: Synthetic peptide
FGCGTKLELK

SEQ ID NO: 6731 - protein, 10 aa, Artificial Sequence
  Description of Artificial Sequence: Synthetic peptide
FGGGTKLELK

SEQ ID NO: 6732 - protein, 10 aa, Artificial Sequence
  Description of Artificial Sequence: Synthetic peptide
FGQGTKLEIK

SEQ ID NO: 6733 - protein, 10 aa, Artificial Sequence
  Description of Artificial Sequence: Synthetic peptide
FGCGTKLEIK

SEQ ID NO: 6734 - protein, 10 aa, Artificial Sequence
  Description of Artificial Sequence: Synthetic peptide
FGSGTKLEIK

SEQ ID NO: 6735 - protein, 10 aa, Artificial Sequence
  Description of Artificial Sequence: Synthetic peptide
FGQGTKLEIK

SEQ ID NO: 6736 - protein, 10 aa, Artificial Sequence
  Description of Artificial Sequence: Synthetic peptide
FGCGTKLELK

SEQ ID NO: 6737 - protein, 10 aa, Artificial Sequence
  Description of Artificial Sequence: Synthetic peptide
FGAGTKLELK

SEQ ID NO: 6738 - protein, 10 aa, Artificial Sequence
  Description of Artificial Sequence: Synthetic peptide
FGQGTRLEIK

SEQ ID NO: 6739 - protein, 10 aa, Artificial Sequence
  Description of Artificial Sequence: Synthetic peptide
FGCGTRLEIK

SEQ ID NO: 6740 - protein, 10 aa, Artificial Sequence
  Description of Artificial Sequence: Synthetic peptide
FGQGTRLEIK

SEQ ID NO: 6741 - protein, 10 aa, Artificial Sequence
  Description of Artificial Sequence: Synthetic peptide
FGQGTKLEIK

SEQ ID NO: 6742 - protein, 10 aa, Artificial Sequence
  Description of Artificial Sequence: Synthetic peptide
FGCGTKLEIK

SEQ ID NO: 6743 - protein, 10 aa, Artificial Sequence
  Description of Artificial Sequence: Synthetic peptide
FGPGTKVDIK

SEQ ID NO: 6744 - protein, 10 aa, Artificial Sequence
  Description of Artificial Sequence: Synthetic peptide
FGCGTKVDIK

SEQ ID NO: 6745 - protein, 10 aa, Artificial Sequence
  Description of Artificial Sequence: Synthetic peptide
FGPGTKVEIK

SEQ ID NO: 6746 - protein, 10 aa, Artificial Sequence
  Description of Artificial Sequence: Synthetic peptide
FGGGTKVEIK

SEQ ID NO: 6747 - protein, 10 aa, Artificial Sequence
  Description of Artificial Sequence: Synthetic peptide
FGGGTKVDIK

SEQ ID NO: 6748 - protein, 10 aa, Artificial Sequence
  Description of Artificial Sequence: Synthetic peptide
FGQGTKVEIK

SEQ ID NO: 6749 - protein, 10 aa, Artificial Sequence
  Description of Artificial Sequence: Synthetic peptide
FGCGTKVEIK

SEQ ID NO: 6750 - protein, 10 aa, Artificial Sequence
  Description of Artificial Sequence: Synthetic peptide
FGPGTKVDIK

SEQ ID NO: 6751 - protein, 10 aa, Artificial Sequence
  Description of Artificial Sequence: Synthetic peptide
FGCGTKVDIK

SEQ ID NO: 6752 - protein, 10 aa, Artificial Sequence
  Description of Artificial Sequence: Synthetic peptide
FGQGTKVEIK

SEQ ID NO: 6753 - protein, 10 aa, Artificial Sequence
  Description of Artificial Sequence: Synthetic peptide
FGQGTKVDIK

SEQ ID NO: 6754 - protein, 10 aa, Artificial Sequence
  Description of Artificial Sequence: Synthetic peptide
FGQGTKLEIK

SEQ ID NO: 6755 - protein, 10 aa, Artificial Sequence
  Description of Artificial Sequence: Synthetic peptide
FGCGTKLEIK

SEQ ID NO: 6756 - protein, 10 aa, Artificial Sequence
  Description of Artificial Sequence: Synthetic peptide
FGQGTKLEIK

SEQ ID NO: 6757 - protein, 10 aa, Artificial Sequence
  Description of Artificial Sequence: Synthetic peptide
FGQGTRLEIK

SEQ ID NO: 6758 - protein, 10 aa, Artificial Sequence
  Description of Artificial Sequence: Synthetic peptide
FGCGTRLEIK

SEQ ID NO: 6759 - protein, 10 aa, Artificial Sequence
  Description of Artificial Sequence: Synthetic peptide
FGQGTRLEIK

SEQ ID NO: 6760 - protein, 10 aa, Artificial Sequence
  Description of Artificial Sequence: Synthetic peptide
FGGGTKLTVL

SEQ ID NO: 6761 - protein, 10 aa, Artificial Sequence
  Description of Artificial Sequence: Synthetic peptide
FGGGTKLTVL

SEQ ID NO: 6762 - protein, 10 aa, Artificial Sequence
  Description of Artificial Sequence: Synthetic peptide
FGGGTKLTVL

SEQ ID NO: 6763 - protein, 10 aa, Artificial Sequence
  Description of Artificial Sequence: Synthetic peptide
FGGGTKLTVL

SEQ ID NO: 6764 - protein, 10 aa, Artificial Sequence
  Description of Artificial Sequence: Synthetic peptide
FGGGTKLTVL

SEQ ID NO: 6765 - protein, 10 aa, Artificial Sequence
  Description of Artificial Sequence: Synthetic peptide
FGGGTKLTVL

SEQ ID NO: 6766 - protein, 10 aa, Artificial Sequence
  Description of Artificial Sequence: Synthetic peptide
FGGGTKLTVL

SEQ ID NO: 6767 - protein, 10 aa, Artificial Sequence
  Description of Artificial Sequence: Synthetic peptide
FGGGTKLTVL

SEQ ID NO: 6768 - protein, 10 aa, Artificial Sequence
  Description of Artificial Sequence: Synthetic peptide
FGGGTKLTVL

SEQ ID NO: 6769 - protein, 10 aa, Artificial Sequence
  Description of Artificial Sequence: Synthetic peptide
FGGGTKLTVL

SEQ ID NO: 6770 - protein, 10 aa, Artificial Sequence
  Description of Artificial Sequence: Synthetic peptide
FGGGTKLTVL

SEQ ID NO: 6771 - protein, 10 aa, Artificial Sequence
  Description of Artificial Sequence: Synthetic peptide
FGGGTKLTVL

SEQ ID NO: 6772 - protein, 10 aa, Artificial Sequence
  Description of Artificial Sequence: Synthetic peptide
FGGGTKLTVL

SEQ ID NO: 6773 - protein, 10 aa, Artificial Sequence
  Description of Artificial Sequence: Synthetic peptide
FGGGTKLTVL

SEQ ID NO: 6774 - protein, 10 aa, Artificial Sequence
  Description of Artificial Sequence: Synthetic peptide
FGGGTKLTVL

SEQ ID NO: 6775 - protein, 10 aa, Artificial Sequence
  Description of Artificial Sequence: Synthetic peptide
FGGGTKLTVL

SEQ ID NO: 6776 - protein, 10 aa, Artificial Sequence
  Description of Artificial Sequence: Synthetic peptide
FGGGTKLTVL

SEQ ID NO: 6777 - protein, 10 aa, Artificial Sequence
  Description of Artificial Sequence: Synthetic peptide
FGGGTKLTVL

SEQ ID NO: 6778 - protein, 10 aa, Artificial Sequence
  Description of Artificial Sequence: Synthetic peptide
FGGGTKLTVL

SEQ ID NO: 6779 - protein, 10 aa, Artificial Sequence
  Description of Artificial Sequence: Synthetic peptide
FGGGTKLTVL

SEQ ID NO: 6780 - protein, 10 aa, Artificial Sequence
  Description of Artificial Sequence: Synthetic peptide
FGGGTKLTVL

SEQ ID NO: 6781 - protein, 10 aa, Artificial Sequence
  Description of Artificial Sequence: Synthetic peptide
FGGGTKLTVL

SEQ ID NO: 6782 - protein, 10 aa, Artificial Sequence
  Description of Artificial Sequence: Synthetic peptide
FGGGTKLTVL

SEQ ID NO: 6783 - protein, 10 aa, Artificial Sequence
  Description of Artificial Sequence: Synthetic peptide
FGGGTKLTVL

SEQ ID NO: 6784 - protein, 10 aa, Artificial Sequence
  Description of Artificial Sequence: Synthetic peptide
FGGGTKLTVL

SEQ ID NO: 6785 - protein, 11 aa, Artificial Sequence
  Description of Artificial Sequence: Synthetic peptide
WGQGTLVTVSS

SEQ ID NO: 6786 - protein, 11 aa, Artificial Sequence
  Description of Artificial Sequence: Synthetic peptide
WGQGTLVTVSS

SEQ ID NO: 6787 - protein, 11 aa, Artificial Sequence
  Description of Artificial Sequence: Synthetic peptide
WGQGTLVTVSS

SEQ ID NO: 6788 - protein, 11 aa, Artificial Sequence
  Description of Artificial Sequence: Synthetic peptide
WGQGTLVTVSS

SEQ ID NO: 6789 - protein, 11 aa, Artificial Sequence
  Description of Artificial Sequence: Synthetic peptide
WGQGTLVTVSS

SEQ ID NO: 6790 - protein, 11 aa, Artificial Sequence
  Description of Artificial Sequence: Synthetic peptide
WGQGTLVTVSS

SEQ ID NO: 6791 - protein, 11 aa, Artificial Sequence
  Description of Artificial Sequence: Synthetic peptide
WGQGTLVTVSS

SEQ ID NO: 6792 - protein, 11 aa, Artificial Sequence
  Description of Artificial Sequence: Synthetic peptide
WGQGTLVTVSS

SEQ ID NO: 6793 - protein, 11 aa, Artificial Sequence
  Description of Artificial Sequence: Synthetic peptide
WGQGTLVTVSS

SEQ ID NO: 6794 - protein, 11 aa, Artificial Sequence
  Description of Artificial Sequence: Synthetic peptide
WGQGTLVTVSS

SEQ ID NO: 6795 - protein, 11 aa, Artificial Sequence
  Description of Artificial Sequence: Synthetic peptide
WGQGTLVTVSS

SEQ ID NO: 6796 - protein, 11 aa, Artificial Sequence
  Description of Artificial Sequence: Synthetic peptide
WGQGTLVTVSS

SEQ ID NO: 6797 - protein, 11 aa, Artificial Sequence
  Description of Artificial Sequence: Synthetic peptide
WGQGTLVTVSS

SEQ ID NO: 6798 - protein, 11 aa, Artificial Sequence
  Description of Artificial Sequence: Synthetic peptide
WGQGTLVTVSS

SEQ ID NO: 6799 - protein, 11 aa, Artificial Sequence
  Description of Artificial Sequence: Synthetic peptide
WGQGTLVTVSS

SEQ ID NO: 6800 - protein, 11 aa, Artificial Sequence
  Description of Artificial Sequence: Synthetic peptide
WGQGTLVTVSS

SEQ ID NO: 6801 - protein, 11 aa, Artificial Sequence
  Description of Artificial Sequence: Synthetic peptide
WGQGTLVTVSS

SEQ ID NO: 6802 - protein, 11 aa, Artificial Sequence
  Description of Artificial Sequence: Synthetic peptide
WGQGTLVTVSS

SEQ ID NO: 6803 - protein, 11 aa, Artificial Sequence
  Description of Artificial Sequence: Synthetic peptide
WGQGTLVTVSS

SEQ ID NO: 6804 - protein, 11 aa, Artificial Sequence
  Description of Artificial Sequence: Synthetic peptide
WGQGTLVTVSS

SEQ ID NO: 6805 - protein, 11 aa, Artificial Sequence
  Description of Artificial Sequence: Synthetic peptide
WGQGTLVTVSS

SEQ ID NO: 6806 - protein, 11 aa, Artificial Sequence
  Description of Artificial Sequence: Synthetic peptide
WGQGTLVTVSS

SEQ ID NO: 6807 - protein, 11 aa, Artificial Sequence
  Description of Artificial Sequence: Synthetic peptide
WGQGTLVTVSS

SEQ ID NO: 6808 - protein, 11 aa, Artificial Sequence
  Description of Artificial Sequence: Synthetic peptide
WGQGTLVTVSS

SEQ ID NO: 6809 - protein, 11 aa, Artificial Sequence
  Description of Artificial Sequence: Synthetic peptide
WGQGTLVTVSS

SEQ ID NO: 6810 - protein, 11 aa, Artificial Sequence
  Description of Artificial Sequence: Synthetic peptide
WGQGTLVTVSS

SEQ ID NO: 6811 - protein, 11 aa, Artificial Sequence
  Description of Artificial Sequence: Synthetic peptide
WGQGTLVTVSS

SEQ ID NO: 6812 - protein, 11 aa, Artificial Sequence
  Description of Artificial Sequence: Synthetic peptide
WGQGTLVTVSS

SEQ ID NO: 6813 - protein, 11 aa, Artificial Sequence
  Description of Artificial Sequence: Synthetic peptide
WGQGTTVTVSS

SEQ ID NO: 6814 - protein, 11 aa, Artificial Sequence
  Description of Artificial Sequence: Synthetic peptide
WGQGTTVTVSS

SEQ ID NO: 6815 - protein, 11 aa, Artificial Sequence
  Description of Artificial Sequence: Synthetic peptide
WGQGTTVTVSS

SEQ ID NO: 6816 - protein, 11 aa, Artificial Sequence
  Description of Artificial Sequence: Synthetic peptide
WGQGTTVTVSS

SEQ ID NO: 6817 - protein, 11 aa, Artificial Sequence
  Description of Artificial Sequence: Synthetic peptide
WGQGTTVTVSS

SEQ ID NO: 6818 - protein, 11 aa, Artificial Sequence
  Description of Artificial Sequence: Synthetic peptide
WGQGTLVTVSS

SEQ ID NO: 6819 - protein, 11 aa, Artificial Sequence
  Description of Artificial Sequence: Synthetic peptide
WGQGTLVTVSS

SEQ ID NO: 6820 - protein, 11 aa, Artificial Sequence
  Description of Artificial Sequence: Synthetic peptide
WGQGTLVTVSS

SEQ ID NO: 6821 - protein, 11 aa, Artificial Sequence
  Description of Artificial Sequence: Synthetic peptide
WGQGTLVTVSS

SEQ ID NO: 6822 - protein, 11 aa, Artificial Sequence
  Description of Artificial Sequence: Synthetic peptide
WGQGTRVTVSS

SEQ ID NO: 6823 - protein, 11 aa, Artificial Sequence
  Description of Artificial Sequence: Synthetic peptide
WGQGTRVTVSS

SEQ ID NO: 6824 - protein, 11 aa, Artificial Sequence
  Description of Artificial Sequence: Synthetic peptide
WGQGTMVTVSS

SEQ ID NO: 6825 - protein, 11 aa, Artificial Sequence
  Description of Artificial Sequence: Synthetic peptide
WGQGTSVTVSS

SEQ ID NO: 6826 - protein, 11 aa, Artificial Sequence
  Description of Artificial Sequence: Synthetic peptide
WGQGTSVTVSS

SEQ ID NO: 6827 - protein, 11 aa, Artificial Sequence
  Description of Artificial Sequence: Synthetic peptide
WGQGTTVTVSS

SEQ ID NO: 6828 - protein, 11 aa, Artificial Sequence
  Description of Artificial Sequence: Synthetic peptide
WGQGTTVTVSS

SEQ ID NO: 6829 - protein, 11 aa, Artificial Sequence
  Description of Artificial Sequence: Synthetic peptide
WGQGTTVTVSS

SEQ ID NO: 6830 - protein, 11 aa, Artificial Sequence
  Description of Artificial Sequence: Synthetic peptide
WGQGTTVTVSS

SEQ ID NO: 6831 - protein, 11 aa, Artificial Sequence
  Description of Artificial Sequence: Synthetic peptide
WGQGTTVTVSS

SEQ ID NO: 6832 - protein, 11 aa, Artificial Sequence
  Description of Artificial Sequence: Synthetic peptide
WGQGTTVTVSS

SEQ ID NO: 6833 - protein, 11 aa, Artificial Sequence
  Description of Artificial Sequence: Synthetic peptide
WGQGTTVTVSS

SEQ ID NO: 6834 - protein, 11 aa, Artificial Sequence
  Description of Artificial Sequence: Synthetic peptide
WGQGTTVTVSS

SEQ ID NO: 6835 - protein, 11 aa, Artificial Sequence
  Description of Artificial Sequence: Synthetic peptide
WGQGTTVTVSS

SEQ ID NO: 6836 - protein, 11 aa, Artificial Sequence
  Description of Artificial Sequence: Synthetic peptide
WGQGTTVTVSS

SEQ ID NO: 6837 - protein, 11 aa, Artificial Sequence
  Description of Artificial Sequence: Synthetic peptide
WGQGTTVTVSS

SEQ ID NO: 6838 - protein, 11 aa, Artificial Sequence
  Description of Artificial Sequence: Synthetic peptide
WGQGTTVTVSS

SEQ ID NO: 6839 - protein, 11 aa, Artificial Sequence
  Description of Artificial Sequence: Synthetic peptide
WGQGTLVTVSS

SEQ ID NO: 6840 - protein, 11 aa, Artificial Sequence
  Description of Artificial Sequence: Synthetic peptide
WGQGTLVTVSS

SEQ ID NO: 6841 - protein, 11 aa, Artificial Sequence
  Description of Artificial Sequence: Synthetic peptide
WGQGTLVTVSS

SEQ ID NO: 6842 - protein, 11 aa, Artificial Sequence
  Description of Artificial Sequence: Synthetic peptide
WGQGTTVTVSS

SEQ ID NO: 6843 - protein, 11 aa, Artificial Sequence
  Description of Artificial Sequence: Synthetic peptide
WGQGTTVTVSS

SEQ ID NO: 6844 - protein, 11 aa, Artificial Sequence
  Description of Artificial Sequence: Synthetic peptide
WGQGTTVTVSS

SEQ ID NO: 6845 - DNA, 255 bp, Artificial Sequence
  Description of Artificial Sequence: Synthetic polynucleotide
gaggtgcagctgctcgagcagtctggacctgagctggtgaagcctggggcctcagtgaagatttcctgcaaggcttctggctacgcattcagtaagtcctggatgaactgggtgaagcagaggcctggaaagggtcttgagtggattggacggatttatcctggagatggagatactaactacaatgggaagttcaagggcaaggccgcactgactgcagacaaatcctccaacacagccaacatgcaactcaac

SEQ ID NO: 6846 - protein, 248 aa, Artificial Sequence
  Description of Artificial Sequence: Synthetic polypeptide
EVQLLEQSGPELVKPGASVKISCKASGYAFSKSWMNWVKQRPGKGLEWIGRIYPGDGDTNYNGKFKGKAALTADKSSNTANMQLNSLTSEDSAVYFCARDGVFYAPLAYWGQGTLVTVSSGGGGSGGGGSGGGGSELVMTQSPSSLAVSVGEKITMSCKSSQSLLYSSNQKNYLAWYQQKPGQSPKLLIYWASTRESGVPDRFTGSGSGTDFTLTISSVKAEDLAVYYCQQYYSYPYTFGGGTKLELK

SEQ ID NO: 6847 - DNA, 255 bp, Artificial Sequence
  Description of Artificial Sequence: Synthetic polynucleotide
gaggtgcagctgctcgagcagtctggacctgagttggtgaagcctggggcctcagtgaagatttcctgcaaggcttctgactacacattcagtaagtcctggatgaactgggtgaagcagaggcctggagagggtcttgagtggattggacgtgtttggcctggagatggagatactacgtacaatgagaagttcaagggcaaggccacactgactgcagacaaatcctccaggacagcctacatgcaactcagc

SEQ ID NO: 6848 - protein, 244 aa, Artificial Sequence
  Description of Artificial Sequence: Synthetic polypeptide
EVQLLEQSGPELVKPGASVKISCKASDYTFSKSWMNWVKQRPGEGLEWIGRVWPGDGDTTYNEKFKGKATLTADKSSRTAYMQLSSLTSEDSAVYFCARGNYFGSSEAYFDYWGQGTRVTVSSGGGGSGGGGSGGGGSELVLTQSPAIMSASPGQKVTITCSASSNVNYIHWYQQKLGSSPKLWIYDTSKLAPGVPARFSGSGSGTSYSLTISSMEAEDAASYFCHQWSSYPPTFGSGTKLEIK

SEQ ID NO: 6849 - DNA, 255 bp, Artificial Sequence
  Description of Artificial Sequence: Synthetic polynucleotide
gaggtgcagctgctcgagcagtctggacctgagctggtgaagcctggggcctcagtgaagatttcctgcaaggcttctggctacgcattcagtagctcctggatgaactgggtgaagcagaggcctggaaagggtcttgagtggattggacggatttatcctggagatggagatactaactacaatgggaagttcaaggacaaggccacactgactgcagacaaatcctccaacacagcctacatgcaactcagc

SEQ ID NO: 6850 - protein, 243 aa, Artificial Sequence
  Description of Artificial Sequence: Synthetic polypeptide
EVQLLEQSGPELVKPGASVKISCKASGYAFSSSWMNWVKQRPGKGLEWIGRIYPGDGDTNYNGKFKDKATLTADKSSNTAYMQLSSLTSEDSAVYFCARRQLNHVFAMDYWGQGTSVTVSSGGGGSGGGGSGGGGSELQMTQSPASLSASVGETVTITCRASGNIHNYLAWYQQKQGKSPQLLVYNAKTLAGGVPSRFSGSGSGTQFSLKINSLQPEDFGSYYCQHHYGTPLTFGAGTKLELK

SEQ ID NO: 6851 - DNA, 255 bp, Artificial Sequence
  Description of Artificial Sequence: Synthetic polynucleotide
gaggtgcagctgctcgagtctggagcagaggtgaaaaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagc

SEQ ID NO: 6852 - protein, 250 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTGYAQKFQGRVTMTRNTSISTAYMELSSLRSEDTAVYYCARGGGYSNGYDYGMDVWGQGTTVTVSSGGGGSGGGGSGGGGSELVMTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPPTFGQGTRLEIK

SEQ ID NO: 6853 - DNA, 255 bp, Artificial Sequence
  Description of Artificial Sequence: Synthetic polynucleotide
gaggtgcagctgctcgagtctggagctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagc

SEQ ID NO: 6854 - protein, 250 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTGYAQKFQGRVTMTRNTSISTAYMELSSLRSEDTAVYYCARGGGYSYGYDYGMDVWGQGTTVTVSSGGGGSGGGGSGGGGSELVMTQSPLSLPVTPGEPASISCRSSQSLLYSNGYHYLDWYLQKPGQSPQLLIYLGSIRASGVPDRFSGSGSGTDFTLKISRVEAEDVGVYYCMQPLQTPPTFGPGTKLEIK

SEQ ID NO: 6855 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggaactggatccgccagcccccagggaaggggctggagtggattggggaaatcagtcatagtggaagcaccaactacaacccgtccctcaagagtcgagtcagcatatcaggagacacgtccaagaaccagttctccctgaagctgagctctgtg

SEQ ID NO: 6856 - protein, 249 aa, Artificial Sequence
  Description of Artificial Sequence: Synthetic polypeptide
EVQLLEWGAGLLKPSETLSLTCAVYGGSFSGYYWNWIRQPPGKGLEWIGEISHSGSTNYNPSLKSRVSISGDTSKNQFSLKLSSVTAADTAVYYCARGGGYSHGYDYGMDVWGQGTTVTVSSGGGGSGGGGSGGGGSELVMTQTPLSLPVIPGEPASISCRSSQSLLYSNGYNYLDWYLQKPGQSPQLLIYLGSKRASGVPDRFSGSGSGTDFTLKISRVEAEDVGVYYCMQGTHWPRTFGQGTKVEIK

SEQ ID NO: 6857 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcagctattagtggtagtggtgatatcacatactacgcagactccgtgaagggccggttcaccatctccagagacaattccaagaacacgctgtatctgcaaatgaacagc

SEQ ID NO: 6858 - protein, 243 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDITYYADSVKGRFTISRDNSKNTLYLQMNSLRAEDTAVYYCAKHLRYFDWPLDYWGQGTLVTVSSGGGGSGGGGSGGGGSELTLTQSPGTLSLSPGERATLSCRASQSVSSSYLAWYQQKPGQAPRLLIYGASSRATGIPDRFSGSGSGTDFTLTISRLEPEDFAVYYCQQYGRSLFTFGPGTKVDIK

SEQ ID NO: 6859 - DNA, 255 bp, Artificial Sequence
  Description of Artificial Sequence: Synthetic polynucleotide
gaggtgcagctgctcgagtccgggggaggcgtggtccagcctgggaggtccctgagactctcctgtgcagcctctggattcaccttccgtagctatcgcatgcactgggtccgccaggctccaggcaaggggctggagtgggtggcagttatatcatatgatggaggtaataaatactatgcagactccgtgaagggccgattcaccatctccagagacaattccaagaacacgctgtatctgcaaatgaacagc

SEQ ID NO: 6860 - protein, 244 aa, Artificial Sequence
  Description of Artificial Sequence: Synthetic polypeptide
EVQLLESGGGVVQPGRSLRLSCAASGFTFRSYRMHWVRQAPGKGLEWVAVISYDGGNKYYADSVKGRFTISRDNSKNTLYLQMNSLRAEDTAVYYCAREQWPNYYYGMDVWGQGTTVTVSSGGGGSGGGGSGGGGSELVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 6861 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggaactggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtg

SEQ ID NO: 6862 - protein, 249 aa, Artificial Sequence
  Description of Artificial Sequence: Synthetic polypeptide
EVQLLEWGAGLLKPSETLSLTCAVYGGSFSGYYWNWIRQPPGKGLEWIGEINHSGSTNYNPSLKSRVTISVDTSKNQFSLKLSSVTAADTAVYYCARGGGYSYGYDYGMDVWGQGTTVTVSSGGGGSGGGGSGGGGSELVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPFTFGPGTKVEIK

SEQ ID NO: 6863 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagctcctatgccatgagctgggtccgccaggctccagggagggggctggagtgggtctcaactattagtggtagtggtggtagcacagactacgcagactccgtgaagggccggttcaccatctccagagacaattccaagaacacgctgtatctgcaaatgaacagc

SEQ ID NO: 6864 - protein, 248 aa, Artificial Sequence
  Description of Artificial Sequence: Synthetic polypeptide
EVQLLESGGGLVQPGGSLRLSCAASGFTFSSYAMSWVRQAPGRGLEWVSTISGSGGSTDYADSVKGRFTISRDNSKNTLYLQMNSLRAEDTAVYYCAKDGGSGWFPKLLHYGLDVWGQGTTVTVSSGGGGSGGGGSGGGGSELQMTQSPSSVSASVGDRVTITCRASQGISSWLAWYQQKPGKAPKLLIYAASSLQSGVPSRFSGSGSGTDFTLTISSLQPEDFATYYCQQANSFPPTFGQGTKVEIK

SEQ ID NO: 6865 - DNA, 255 bp, Artificial Sequence
  Description of Artificial Sequence: Synthetic polynucleotide
gaggtgcagctgctcgagtctggagcagaggtgaaaaagcctggggcctcagtgaaggtctcctgcatggcttctggatacaccttcaccggttatgatatcaactgggtgcgacaggccactgggcaagggcttgagtggatgggatggatgaaccctaaccgtggcaccacaggctatgcacagaagttccagggcagagtcaccatgaccaggaacacctccataagcacagcctacatggagctgagcagc

SEQ ID NO: 6866 - protein, 250 aa, Artificial Sequence
  Description of Artificial Sequence: Synthetic polypeptide
EVQLLESGAEVKKPGASVKVSCMASGYTFTGYDINWVRQATGQGLEWMGWMNPNRGTTGYAQKFQGRVTMTRNTSISTAYMELSSLRSEDTAVYYCARGGGYSYGYDYGMDVWGQGTTVTVSSGGGGSGGGGSGGGGSELVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPLTFGGGTKVEIK

SEQ ID NO: 6867 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcagctattagtggtagtggtgattacacatactacgcagactccgtgaagggccggttcaccatctccagagacaattccaagaacacgctgtatctgcaaatgaacagc

SEQ ID NO: 6868 - protein, 243 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDYTYYADSVKGRFTISRDNSKNTLYLQMNSLRAEDTAVYYCAKHLRYSDWPLDYWGQGTLVTVSSGGGGSGGGGSGGGGSELVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 6869 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggacctggatccgccagcccccagggaaggggctggagtggattggggaaatcaatcacagtggaagaaccaactacaatccgtccctcaagagtcgcgtcaccatgtcagaagacacggccaagaaccagttctccctgaagctgagctctgtg

SEQ ID NO: 6870 - protein, 249 aa, Artificial Sequence
  Description of Artificial Sequence: Synthetic polypeptide
EVQLLEWGAGLLKPSETLSLTCAVYGGSFSGYYWTWIRQPPGKGLEWIGEINHSGRTNYNPSLKSRVTMSEDTAKNQFSLKLSSVTAADTAVYYCARGGGYSDGYDYGMDVWGQGTTVTVSSGGGGSGGGGSGGGGSELVLTQSPLSLPVSPGEPASISCRSSQSLLYSNGYNYVDWYLQKPGQSPQLLIYLGSNRASGVPDRFSGSGSGTDFTLKISRVEAEDVGVYYCMQGTHWPLTFGGGTKVDIK

SEQ ID NO: 6871 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggaactggatccgccagcccccagggaaggggctggagtggattggggaaatcaatcatcgtggaagcaccaactacaacccgtccctcaagagtcgagtcaccatatcagtagacgcgtccaagaaccagttctccctgaagctgagttctgtg

SEQ ID NO: 6872 - protein, 249 aa, Artificial Sequence
  Description of Artificial Sequence: Synthetic polypeptide
EVQLLEWGAGLLKPSETLSLTCAVYGGSFSGYYWNWIRQPPGKGLEWIGEINHRGSTNYNPSLKSRVTISVDASKNQFSLKLSSVTAADTAVYYCARGGGYSDGYDYGMDVWGQGTTVTVSSGGGGSGGGGSGGGGSELVMTQTPLSLPVSPGEPASISCRSSQSLLYSNGYNYVDWYLQKPGQSPQLLIYLGSNRASGVPDRFSGSGSGTDFTLKISKVEAEDVGVYYCMQALQTPCSFGQGTKLEIK

SEQ ID NO: 6873 - DNA, 255 bp, Artificial Sequence; identical to SEQ ID NO: 6861
  Description of Artificial Sequence: Synthetic polynucleotide

SEQ ID NO: 6874 - protein, 249 aa, Artificial Sequence
  Description of Artificial Sequence: Synthetic polypeptide
EVQLLEWGAGLLKPSETLSLTCAVYGGSFSGYYWNWIRQPPGKGLEWIGEINHSGSTNYNPSLKSRVTISVDTSKNQFSLKLSSVTAADTAVYYCARGGGYSYGYDYGMDVWGQGTTVTVSSGGGGSGGGGSGGGGSELVMTQSPLSLPVTPGEPASISCRSSQRLLFSNGYHYLDWYLQKPGQSPQLLIYLGSNRASGVPDRFSGSGSGTDFTLKISRVEAEDVGVYYCMQALQTPPTFGQGTKLEIK

SEQ ID NO: 6875 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcggtgtctatggtgggtccttcagtggttactactggagctggatccgccagcccccagggaaggggctggagtggattggggaaatcaatcatcgtggaagcaccaactacaacccgtccctcaagagtcgagtcaccatatcagtagacgcgtccaagaaccagttctccctgaagctgagctctgtg

SEQ ID NO: 6876 - protein, 249 aa, Artificial Sequence
  Description of Artificial Sequence: Synthetic polypeptide
EVQLLEWGAGLLKPSETLSLTCGVYGGSFSGYYWSWIRQPPGKGLEWIGEINHRGSTNYNPSLKSRVTISVDASKNQFSLKLSSVTAADTAVYYCARGGGYSYGYDYGMDVWGQGTTVTVSSGGGGSGGGGSGGGGSELVLTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPPTFGQGTKLEIK

SEQ ID NO: 6877 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatggcatgagctgggtccgccaggctccagggaaggggctggagtgggtctcagctattagtggtagtggtggtagcacatactacgcagactccgcgaagggccggttcaccatctccagagacaattccaagaacacgctgtatctgcaaatgaacagc

SEQ ID NO: 6878 - protein, 243 aa, Artificial Sequence
  Description of Artificial Sequence: Synthetic polypeptide
EVQLLESGGGLVQPGGSLRLSCAASGFTFSSYGMSWVRQAPGKGLEWVSAISGSGGSTYYADSAKGRFTISRDNSKNTLYLQMNSLRAEDTAVYYCAKLVTPDYYYGMDVWGQGTTVTVSSGGGGSGGGGSGGGGSELQMTQSPSSLSASVGDRVTITCRASQSISSYLNWYQQKPGKAPKLLIYDASSLQSGVPSRFSGSGSGTDFTLTISSLQPEDFATYYCQQSYRTPPTFGQGTKVDIK

SEQ ID NO: 6879 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtg

SEQ ID NO: 6880 - protein, 249 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDTSKNQFSLKLSSVTAADTAVYYCARGGGYSYGYDYGMDVWGQGTTVTVSSGGGGSGGGGSGGGGSELVLTQSPLSLPVTPGEPASISCRSSQSLLYSNGYHYLDWYLQKPGQSPQLLIFLGSNRASGVPDRFSASRSGTDFTLKISRVEAEDVGVYYCMQALQTPFTFGPGTKVEIK

SEQ ID NO: 6881 - DNA, 255 bp, Artificial Sequence; identical to SEQ ID NO: 6851
  Description of Artificial Sequence: Synthetic polynucleotide

SEQ ID NO: 6882 - protein, 250 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTGYAQKFQGRVTMTRNTSISTAYMELSSLRSEDTAVYYCARGGGYSNGYDYGMDVWGQGTTVTVSSGGGGSGGGGSGGGGSELVMTQTPLSLPVSPGEPASISCRSSQSLLYSNGYNYLDWYLQKPGQSPQLLIYLGSNRASGVPDRFSGSGSGTDFTLKISRVEAEDVGVYYCMQALQTPITFGQGTRLEIK

SEQ ID NO: 6883 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggaactggatccgccagcccccagggaaggggctggagtggattggggaaatcaatcatagtggaagcaccacctacaacccgtccctcaagagtcgagtcaccatatcagaagacacgtccaggaaccagttctccctgaagctgagttctgtg

SEQ ID NO: 6884 - protein, 249 aa, Artificial Sequence
  Description of Artificial Sequence: Synthetic polypeptide
EVQLLEWGAGLLKPSETLSLTCAVYGGSFSGYYWNWIRQPPGKGLEWIGEINHSGSTTYNPSLKSRVTISEDTSRNQFSLKLSSVTAADTAVYYCTRGGGYSHGYDYGMDVWGQGTTVTVSSGGGGSGGGGSGGGGSELVMTQSPLSLPVTPGEPASISCRSSQSLLYSNGYNYLDWYLQKPGQSPQLLIYLGSNRASGVPDRFSGSGSGTDFTLQISRVEAEDVGVYYCMQGTHWPFTFGPGTKVEIK

SEQ ID NO: 6885 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggtttctactggaactggatccgccagcccccagggaaggggctggagtggattggggaaatcaatcatcgtggaagcaccaactacaacccgtccctcaagagtcgagtcaccatatcagtagacgcgtccaagaaccagttctccctgaagctgagttctgtg

SEQ ID NO: 6886 - protein, 249 aa, Artificial Sequence
  Description of Artificial Sequence: Synthetic polypeptide
EVQLLEWGAGLLKPSETLSLTCAVYGGSFSGFYWNWIRQPPGKGLEWIGEINHRGSTNYNPSLKSRVTISVDASKNQFSLKLSSVTAADTAVYYCARGGGYSDGYDYGMDVWGQGTTVTVSSGGGGSGGGGSGGGGSELVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPWTFGQGTKVDIK

SEQ ID NO: 6887 - DNA, 255 bp, Artificial Sequence; identical to SEQ ID NO: 6855
  Description of Artificial Sequence: Synthetic polynucleotide

SEQ ID NO: 6888 - protein, 249 aa, Artificial Sequence
  Description of Artificial Sequence: Synthetic polypeptide
EVQLLEWGAGLLKPSETLSLTCAVYGGSFSGYYWNWIRQPPGKGLEWIGEISHSGSTNYNPSLKSRVSISGDTSKNQFSLKLSSVTAADTAVYYCARGGGYSHGYDYGMDVWGQGTTVTVSSGGGGSGGGGSGGGGSELVMTQSPLSLPVSPGEPASISCRSSQSLLYSNGYNYVDWYLQKPGQSPQLLIYLGSNRASGVPDRFSGSGSGTDFTLKISRVEAEDVGVYYCMQSIQLPWTFGQGTKVDIK

SEQ ID NO: 6889 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacgcgtccaagaaccagttctccctgaagctgagttctgtg

SEQ ID NO: 6890 - protein, 249 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDASKNQFSLKLSSVTAADTAVYYCARGGGYSDGYDYGMDVWGQGTTVTVSSGGGGSGGGGSGGGGSELVLTQSPLSLPVTPGEPASISCRSSQSLLYSNGYNYLDWYLQKPGQSPHLLIYLGSYRASGVPDRFSGSASGTDFTLKISRVEAEDVGVYYCMQGTHWPLTFGGGTKLEIK

SEQ ID NO: 6891 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggagctggatccgccagcccccagggaaggggctggagtggattggggaaatcactcatagtggaagcaccaactacaacccgtccctcaagagtcgagtcaccatatcagtagacacgtccaagaacctgttctccctgaagctgagctctgtg

SEQ ID NO: 6892 - protein, 249 aa, Artificial Sequence
  Description of Artificial Sequence: Synthetic polypeptide
EVQLLEWGAGLLKPSETLSLTCAVYGGSFSGYYWSWIRQPPGKGLEWIGEITHSGSTNYNPSLKSRVTISVDTSKNLFSLKLSSVTAADTAVYYCARGGGYSDGYDYGMDVWGQGTTVTVSSGGGGSGGGGSGGGGSELVMTQTPLSLPVIPGEPASISCRSSQSLLFSNGYNYLDWYLQKPGQSPQLLIYLVSKRASGVPDRFSGSGSGTDFTLKISRVEAEDVGVYYCMQALQTPLTFGGGTKLEIK

SEQ ID NO: 6893 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagc

SEQ ID NO: 6894 - protein, 243 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYFCAKVMTPDYYYDMDVWGQGTTVTVSSGGGGSGGGGSGGGGSELQMTQSPSSVSASVGDRVTITCRASQSISSYLNWYQQKPGKAPKLLIYAASSLQSGVPSRFSGSGSGTDFTLTISSLQPEDFAAYYCQQSYSTPPTFGQGTKVEIK

SEQ ID NO: 6895 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatggcatgagctgggtccgccaggctccagggaagggactggagtgggtctcagctattagtggtagtggtggtagcacatactacgcagactccgtgaagggccggttcaccatctccagagacaattccaagaacacgctgtatctgcaaatgaacagc

SEQ ID NO: 6896 - protein, 243 aa, Artificial Sequence
  Description of Artificial Sequence: Synthetic polypeptide
EVQLLESGGGLVQPGGSLRLSCAASGFTFSSYGMSWVRQAPGKGLEWVSAISGSGGSTYYADSVKGRFTISRDNSKNTLYLQMNSLRAEDTAVYFCAKVMTPDYYYDMDVWGQGTTVTVSSGGGGSGGGGSGGGGSELQMTQSPSSLSASVGDRVTITCRASQGISNYLAWYQQKPGKVPKLLIYAASSLQSGVPSRFSGSGSGTDFTLTISSLQPEDFATYYCQQSYSTPFTFGPGTKVEIK

SEQ ID NO: 6897 - DNA, 255 bp, Artificial Sequence; identical to SEQ ID NO: 6879
  Description of Artificial Sequence: Synthetic polynucleotide

SEQ ID NO: 6898 - protein, 249 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDTSKNQFSLKLSSVTAADTAVYYCARGGGYSYGYDYGMDVWGQGTTVTVSSGGGGSGGGGSGGGGSELVMTQTPLSLPVTPGEPASISCRSSQSLLYSNGYNYLDWYLQKPGQSPQLLIYLGSNRASGVPDRFSGSGSGTDFTLKISRVEAEDVGVYYCMQGTHWPFTFGPGTKVEIK

SEQ ID NO: 6899 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtgactccatcagccgtgatccttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagc

SEQ ID NO: 6900 - protein, 253 aa, Artificial Sequence
  Description of Artificial Sequence: Synthetic polypeptide
EVQLLESGPGLVKPSQTLSLTCTVSGDSISRDPYYWSWIRQHPGKGLEWIGYIYYSGSTYYNPSLKSRVTISVDTSKNQFSLKLSSVTAADTAVYYCARDKLWFGKLNYYYGMDVWGQGTTVTVSSGGGGSGGGGSGGGGSELVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK

SEQ ID NO: 6901 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatttcagttgacccgtccaagaaccagttctccctgaagctgagctctgtg

SEQ ID NO: 6902 - protein, 249 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDPSKNQFSLKLSSVTAADTAVYYCARGGGYSYGYDYGMDVWGQGTTVTVSSGGGGSGGGGSGGGGSELVLTQSPLSLPVTPGEPASISCRSSQSLLFSNGYYYLDWYLQKPGQSPQLLIYLGSNRASGVPDRFSGSGSGTDFTLKISRVEAEDVGVYYCMQALQTPPTFGQGTKVEIK

SEQ ID NO: 6903 - DNA, 255 bp, Artificial Sequence; identical to SEQ ID NO: 6861
  Description of Artificial Sequence: Synthetic polynucleotide

SEQ ID NO: 6904 - protein, 249 aa, Artificial Sequence
  Description of Artificial Sequence: Synthetic polypeptide
EVQLLEWGAGLLKPSETLSLTCAVYGGSFSGYYWNWIRQPPGKGLEWIGEINHSGSTNYNPSLKSRVTISVDTSKNQFSLKLSSVTAADTAVYYCARGGGYSYGYDYGMDVWGQGTTVTVSSGGGGSGGGGSGGGGSELVMTQSPLSLPVTPGEPASISCRSSQSLLYSNGYNYLDWYLQKPGQSPQLLIYLGSNRASGVPDRFSGSRSGTDFTLKISRVEAEDVGVYYCMQALQTPFTFGPGTKVDIK

SEQ ID NO: 6905 - DNA, 255 bp, Artificial Sequence
  Description of Artificial Sequence: Synthetic polynucleotide
gaggtgcagctgctcgagtccgggggaggcttggtacagccgggggggtccctgagactctcctgtgcagcctctggattcacctttagcagctttgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagc

SEQ ID NO: 6906 - protein, 243 aa, Artificial Sequence
  Description of Artificial Sequence: Synthetic polypeptide
EVQLLESGGGLVQPGGSLRLSCAASGFTFSSFAMSWVRQAPGKGLEWVSAISGSGGSTYYADSVKGRFTISRDNSKNTLYLQMNSLRAEDTAEYYCAKMVTPDYYYDMDVWGQGTTVTVSSGGGGSGGGGSGGGGSELVMTQSPSSLSASVGDRVTITCRASQGISNYLAWYQQKPGKVPKLLIYAASTLQSGVPSRFSGSGSGTDFTLTISSLQPEDFATYYCQQSYSTPPTFGQGTKVEIK

SEQ ID NO: 6907 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcgctgtctatggtgggtccctcagtggttactactggagctggatccgccagcccccagggaaggggctggagtggattggggaaatcaatcacagtggaagaaccaactacaatccgtccctcaagagtcgcgtcaccatgtcagaagacacggccaagaaccagttctccctgaagctgagctctgtg

SEQ ID NO: 6908 - protein, 248 aa, Artificial Sequence
  Description of Artificial Sequence: Synthetic polypeptide
EVQLLEWGAGLLKPSETLSLTCAVYGGSLSGYYWSWIRQPPGKGLEWIGEINHSGRTNYNPSLKSRVTMSEDTAKNQFSLKLSSVTAADTAVYYCARGGGYSDGYDYGMDVWGQGTTVTVSSGGGGSGGGGSGGGGSELVMTQTPLSLPVTPGEPASISCRSSQSLLYSNGYNYLDWYLQKPGQSPQLLIYLGSNRASGVPDRFSGSGSGTDFTLKISRVEAEDVGVYYCMQALQSLTFGGGTKLEIK

SEQ ID NO: 6909 - DNA, 255 bp, Artificial Sequence; identical to SEQ ID NO: 6879
  Description of Artificial Sequence: Synthetic polynucleotide

SEQ ID NO: 6910 - protein, 249 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDTSKNQFSLKLSSVTAADTAVYYCARGGGYSYGYDYGMDVWGQGTTVTVSSGGGGSGGGGSGGGGSELVMTQTPLSLPVTPGEPASISCRSSQSLLYSNGYNYLDWYLQKPGQSPQLLIYLGSKRASGVPDRFSGSGSGTDFTLKISRVEAEDVGVYYCMQALQTPLTFGGGTKVDIK

SEQ ID NO: 6911 - DNA, 255 bp, Artificial Sequence
  Description of Artificial Sequence: Synthetic polynucleotide
gaggtgcagctgctcgagtggggcgcaggactgttgaagccttcggagaccctgtccctcacctgcggtgtctatggtgggtccttcagtggttactactggaactggatccgccagcccccagggaaggggctggagtggattggggaaatcaatcatcgtggaagcaccaactacaacccgtccctcaagagtcgagtcaccatatcagtagacgcgtccaagaaccagttctccctgaagctgagttctgtg

SEQ ID NO: 6912 - protein, 248 aa, Artificial Sequence
  Description of Artificial Sequence: Synthetic polypeptide
EVQLLEWGAGLLKPSETLSLTCGVYGGSFSGYYWNWIRQPPGKGLEWIGEINHRGSTNYNPSLKSRVTISVDASKNQFSLKLSSVTAADTAVYYCARGGGYSDGYDYGMDVWGQGTTVTVSSGGGGSGGGGSGGGGSELVMTQSPLSLSVTPGEPASISCRSSRSLLHSNGYNYLDWYLQKPGQSPQLLIYLGSNRASGVPDRFSGSGSGIDFTLKISRVEAEDVGVYYCMQALQTPHFGGGTKVEIK

SEQ ID NO: 6913 - DNA, 255 bp, Artificial Sequence; identical to SEQ ID NO: 6853
  Description of Artificial Sequence: Synthetic polynucleotide

SEQ ID NO: 6914 - protein, 250 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTGYAQKFQGRVTMTRNTSISTAYMELSSLRSEDTAVYYCARGGGYSYGYDYGMDVWGQGTTVTVSSGGGGSGGGGSGGGGSELVMTQSPLSLSVTPGQPASISCKSSQSLLYSNGYNYLDWYLQKPGQSPQLLIYLGSNRASGVPDRFSGSGSGTDFTLKISRVEAEDVGVYYCMQALQTPITFGQGTRLEIK

SEQ ID NO: 6915 - DNA, 255 bp, Artificial Sequence
  Description of Artificial Sequence: Synthetic polynucleotide
gaggtgcagctgctcgagtctgggggaggcgtggtccagcctgggaggtccctgagactctcctgtgcagcgtctggattcaccttcagcagatacggcatggactgggtccgccaggctccaggcaaggggctggagtgggtggcacttatatggtatgatggaagtaataaatactatgcagactccgtgaagggccgattcaccatctccagagacaattccaagaacacgctgtatctgcaaatgaacagc

SEQ ID NO: 6916 - protein, 251 aa, Artificial Sequence
  Description of Artificial Sequence: Synthetic polypeptide
EVQLLESGGGVVQPGRSLRLSCAASGFTFSRYGMDWVRQAPGKGLEWVALIWYDGSNKYYADSVKGRFTISRDNSKNTLYLQMNSLRAEDTAVYYCARNYGSGSYGAYYYHGMDVWGQGTTVTVSSGGGGSGGGGSGGGGSELALTQPPSVSGSPGQSITISCTGTSSDVGGYNYVSWYQQHPGKAPKLMIYEVSKRPSGVSNRFSGSKSGNTASLTISGLQAEDEADYYCSSYTSSSTLVFGGGTKLTVL

SEQ ID NO: 6917 - DNA, 255 bp, Artificial Sequence
  Description of Artificial Sequence: Synthetic polynucleotide
gaggtgcagctgctcgagtctggagctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacagactatgcacagaagttccagggcagagtcaccatgaccaggaacacctccataagcacagcctacatggagctgagcagc

SEQ ID NO: 6918 - protein, 249 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTDYAQKFQGRVTMTRNTSISTAYMELSSLRSEDTAVYYCVRGWGTYYYYGMDVWGQGTTVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 6919 - DNA, 255 bp, Artificial Sequence
  Description of Artificial Sequence: Synthetic polynucleotide
gaggtgcagctgctcgagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacagactatgcacagaagttccagggcagagtcaccatgaccaggaacacctccataagcacagcctacatggagctgagcagc

SEQ ID NO: 6920 - protein, 249 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTDYAQKFQGRVTMTRNTSISTAYMELSSLRSEDTAVYYCARGWGRYYSYGMDVWGQGTTVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 6921 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctggagtgggtctcagctattagtggtagtggtgatatcacatactacgcagactccgtgaagggccggttcaccatctccagagacaattccaagaacacgctgtatctgcaaatgaacagc

SEQ ID NO: 6922 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDITYYADSVKGRFTISRDNSKNTLYLQMNSLRAEDTAVYYCAKHLRYFDWPLDYWGQGTLVTVSSGGGGSGGGGSGGGGSELTLTQSPGTLSLSPGERATLSCRASQSVSSSYLAWYQQKPGQAPRLLIYGASARATGIPDRFSGSGSGTDFTLTISRLEPEDFAVYYCQQYGSSLTFGGGTKVDIK

SEQ ID NO: 6923 - DNA, 255 bp, Artificial Sequence
  Description of Artificial Sequence: Synthetic polynucleotide
gaggtgcagctgctcgagtctgggggaggcctggtcaagcctggggggtccctgagactctcctgtgcagcctctggattcaccttcagtggctatagcatgaactgggtccgccaggctccagggaaggggctggagtgggtctcgtccattagtagtagtagtagttacatatactacgcagactcagtgaagggccgcttcaccatctccagagacaacgccaagaactcactgtatctgcaaatgaacagc

SEQ ID NO: 6924 - protein, 246 aa, Artificial Sequence
  Description of Artificial Sequence: Synthetic polypeptide
EVQLLESGGGLVKPGGSLRLSCAASGFTFSGYSMNWVRQAPGKGLEWVSSISSSSSYIYYADSVKGRFTISRDNAKNSLYLQMNSLRAEDTAVYYCVRSKAARPDDGMDVWGQGTTVTVSSGGGGSGGGGSGGGGSELVLTQPPSASGTPGQRITISCSGSSSNIGSNYVYWYQHLPGTAPKLLIYRNNQRPSGVPDRFSGSKSGTSASLAISGLRSEDEADYYCAAWDDSLSGVVFGGGTKLTVL

SEQ ID NO: 6925 - DNA, 255 bp, Artificial Sequence
  Description of Artificial Sequence: Synthetic polynucleotide
gaggtgcagctgctcgagtctgggggaggcttggtacagccgggggggtccctgagactctcctgtgcagcctctggattcacctttagctcctatgccatgagctgggtccgccaggctccagggagggggctggagtgggtctcaagcataactattactggtggtagcacatactacgcagactccgtgaagggccggttcaccatctccagagacaattccaagaacacgctgaatctgcaaatgaacagc

SEQ ID NO: 6926 - protein, 248 aa, Artificial Sequence
  Description of Artificial Sequence: Synthetic polypeptide
EVQLLESGGGLVQPGGSLRLSCAASGFTFSSYAMSWVRQAPGRGLEWVSSITITGGSTYYADSVKGRFTISRDNSKNTLNLQMNSLRAEDTAVYYCAKDGGSGWFPKLLHYGLDVWGQGTTVTVSSGGGGSGGGGSGGGGSELVMTQSPSSLSASVGDRVTITCQASQDISNYLNWYQQKPGKAPKLLIYDASNLETGVPSRFSGSGSGTDFTFTISSLQPEDFATYYCQQSYSIPPTFGQGTKVEIK

SEQ ID NO: 6927 - DNA, 255 bp, Artificial Sequence
  Description of Artificial Sequence: Synthetic polynucleotide
gaggtgcagctgctcgagtctgggggaggcgtggtccagcctgggaggtccctgagactctcctgtgcagcgtctggattcaccttcagtagatatggcatgcagtgggtccgccaggctccaggcaaggggctggagtgggtggcagttatatcatatgatggaagtaataaatactatgcagactccgtgaagggccgattcaccatctccagagacaattccaagaacacgctatatctgcaaatgaacagc

SEQ ID NO: 6928 - protein, 251 aa, Artificial Sequence
  Description of Artificial Sequence: Synthetic polypeptide
EVQLLESGGGVVQPGRSLRLSCAASGFTFSRYGMQWVRQAPGKGLEWVAVISYDGSNKYYADSVKGRFTISRDNSKNTLYLQMNSLRAEDTAVYYCARNYGSGSYGAYYYHGMDVWGQGTTVTVSSGGGGSGGGGSGGGGSELVLTQPPSVSKGLRQTATLTCTGNSNNVGNQGAAWLQQHQGHPPKLLSYRNNNRPSGISERLSASRSGNTASLTITGLQPEDEADYYCSAWDSSLSAWVFGGGTKLTVL

SEQ ID NO: 6929 - DNA, 255 bp, Artificial Sequence
  Description of Artificial Sequence: Synthetic polynucleotide
gaggtgcagctgctcgagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataagtactatgcagactccgtgaagggccgattcaccatctccagagacaattccaagaacacgctgtttctgcaaatgaacagc

SEQ ID NO: 6930 - protein, 246 aa, Artificial Sequence
  Description of Artificial Sequence: Synthetic polypeptide
EVQLLESGGGVVQPGRSLRLSCAASGFTFSSYGMHWVRQAPGKGLEWVAVISYDGSNKYYADSVKGRFTISRDNSKNTLFLQMNSLRTEDTAVYYCAREQWPNYYYGLGVWGQGTTVTVSSGGGGSGGGGSGGGGSELVLTQPSSVSKDLRQTATLTCTGNSNNVGNQGAAWLQQHQGHPPKLLSYRNNNRPSGISERLSASRSGNTASLTITGLQPEDEADYYCSAWDSSLSAWVFGGGTKLTVL

SEQ ID NO: 6931 - DNA, 255 bp, Artificial Sequence
  Description of Artificial Sequence: Synthetic polynucleotide
gaggtgcagctgctcgagtctggagcagaggtgaaaaagcctggggcctcagtgaaggtctcctgcaaggcttctggatacaccttcaccagttatgatatcaactgggtgcgccaggccactggacaagggcttgagtggatgggatggatgaaccctaacagtggtaacacagactatgcacagaagttccagggcagagtcaccatgaccaggaacacctccataagcacagcctacatggagctgagaagc

SEQ ID NO: 6932 - protein, 249 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTDYAQKFQGRVTMTRNTSISTAYMELRSLRSEDTAVYYCARGWGRFYSYGMDVWGQGTTVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKLEIK

SEQ ID NO: 6933 - DNA, 255 bp, Artificial Sequence
  Description of Artificial Sequence: Synthetic polynucleotide
gaggtgcagctgctcgagtctggagcagaggtgaaaaagcctggggcctcagtgaaggtctcctgcaaggcttctggatacaccttcaccagttatgatatcaactgggtgcgacaggccactggacaagggcttgagtggatgggatggatgaaccctaacagtggtaacacagactatacacagaagttccagggcagagtcaccatgaccaggaacacctccataggcacagcctacatggagctgagcagc

SEQ ID NO: 6934 - protein, 249 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTDYTQKFQGRVTMTRNTSIGTAYMELSSLRSEDTAVYYCVRGWGTYYYYGMDVWGQGTTVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKLEIK

SEQ ID NO: 6935 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtggctccatcagcagtggtgattactactggagctggatccgccagcacccagggaagggcctggagtggattgggtacatcaatgacagtgggagcacctactataacccgtccctcaagagtcgagttaccttatcagtagactcgtctaagaaccagttctccctgaagctgagc

SEQ ID NO: 6936 - protein, 253 aa, Artificial Sequence
  Description of Artificial Sequence: Synthetic polypeptide
EVQLLESGPGLVKPSQTLSLTCTVSGGSISSGDYYWSWIRQHPGKGLEWIGYINDSGSTYYNPSLKSRVTLSVDSSKNQFSLKLSSVTAADTAVYYCARDLLWFGKLNYYYGMDVWGQGTTVTVSSGGGGSGGGGSGGGGSELVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIK

SEQ ID NO: 6937 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcaggtattagtggtagtggtggtagcacatactacgcagactccgtgaagggccggttcaccatctccagagacaattccaagaacacgctgtatctgcaaatgaacagc

SEQ ID NO: 6938 - protein, 244 aa, Artificial Sequence
  Description of Artificial Sequence: Synthetic polypeptide
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKVMTPDYYYDMDVWGQGTTVTVSSGGGGSGGGGSGGGGSELTLTQSPGTLSLSPGERATLSCRASQSVSSGYLAWYQQKPGQAPRLLIYGASSRATGIPDRFSGSGSGTDFTLTISRLEPEDFAVYYCQQYGSSPFTFGPGTKVEIK

SEQ ID NO: 6939 - DNA, 255 bp, Artificial Sequence
  Description of Artificial Sequence: Synthetic polynucleotide
gaggtgcagctgctcgagtcgggcccaggactggtgaagccttcggagaccctgtccctcacctgcactgtctctggtgactccatcagtagtagtcgttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagt

SEQ ID NO: 6940 - protein, 249 aa, Artificial Sequence
  Description of Artificial Sequence: Synthetic polypeptide
EVQLLESGPGLVKPSETLSLTCTVSGDSISSSRYYWGWIRQPPGKGLEWIGSIYYSGSTYYNPSLKSRVTISVDTSKNQFSLKLSSVTAADTAVYYCARGIFGVITYFDYWGQGTLVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 6941 - DNA, 255 bp, Artificial Sequence
  Description of Artificial Sequence: Synthetic polynucleotide
gaggtgcagctgctcgagtcaggtccaggacaggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcag

SEQ ID NO: 6942 - protein, 255 aa, Artificial Sequence
  Description of Artificial Sequence: Synthetic polypeptide
EVQLLESGPGQVKPSQTLSLTCAISGDSVSSNSAAWNWIRQSPSRGLEWLGRTYYRSKWYNDYAVSVKSRITINPDTSKNQFSLQLNSVTPEDTAVYYCAREVLWFGKLNYYYGMDVWGQGTTVTVSSGGGGSGGGGSGGGGSELVLTQSPLSLPVTPGEPASISCRSSQSLLHRNGYNYLDWYLQKPGQSPQLLIYLGSNRASGVPDRFSGSGSGTDFTLKISRVEAEDVGVYYCMQALQTPITFGQGTRLEIK

SEQ ID NO: 6943 - DNA, 255 bp, Artificial Sequence
  Description of Artificial Sequence: Synthetic polynucleotide
gaggtgcagctgctcgagtcgggcccaggactggtgaagccttcggagaccctgtccctcacctgcattgtctctggtgtctccatcagcagtagtaggtcctactggggctggatccgccagcccccagggaagggactggagtggattgggagtatctattatggtgggagcacctactacaacccgtccctcaagagtcgagtcaccatatccgttgacacgtccaagaaccagttctccctgaagctgagc

SEQ ID NO: 6944 - protein, 249 aa, Artificial Sequence
  Description of Artificial Sequence: Synthetic polypeptide
EVQLLESGPGLVKPSETLSLTCIVSGVSISSSRSYWGWIRQPPGKGLEWIGSIYYGGSTYYNPSLKSRVTISVDTSKNQFSLKLSSVTAADTAVYYCATTIFGVVGWFDPWGQGNLVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 6945 - DNA, 255 bp, Artificial Sequence
  Description of Artificial Sequence: Synthetic polynucleotide
gaggtgcagctgctcgagtctggtcctgcgctggtgaaacccacacagaccctcacgctgacctgcaccttctctggtttctcattcaccactcataaaatgggtgtggactggatccgtcagcccccaggaaaggccctggagtggcttgcactcatttattggaatgatgatacgcgctacagcccatctctgcagagtaggctcaccatcaccaaggacacctccaaaaaccaggtggtcctcacaatgacc

SEQ ID NO: 6946 - protein, 245 aa, Artificial Sequence
  Description of Artificial Sequence: Synthetic polypeptide
EVQLLESGPALVKPTQTLTLTCTFSGFSFTTHKMGVDWIRQPPGKALEWLALIYWNDDTRYSPSLQSRLTITKDTSKNQVVLTMTNMDPVDTATYYCVYRRYNWNYENWFDPWGQGTLVTVSSGGGGSGGGGSGGGGSELVMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKLEIK

SEQ ID NO: 6947 - DNA, 255 bp, Artificial Sequence
  Description of Artificial Sequence: Synthetic polynucleotide
gaggtgcagctgctcgagtccgggggaggcctggtcaagcctggggggtccctgagactctcctgtgcagcctctggattcacctttagcatctatgccttgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagc

SEQ ID NO: 6948 - protein, 246 aa, Artificial Sequence
  Description of Artificial Sequence: Synthetic polypeptide
EVQLLESGGGLVKPGGSLRLSCAASGFTFSIYALSWVRQAPGKGLEWVSAISGSGGSTYYADSVKGRFTISRDNSKNTLYLQMNSLRAEDTAVYYCAKGEGIAARYYYYGMDVWGQGTTVTVSSGGGGSGGGGSGGGGSELVMTQSPSSLSASVGDRVTITCRASQSISSYLNWYQQKPGKAPKLLIYATSSLQSGVPSRFSGSGSGTDFTLTISSLQPEDFATYYCQQSYSTPPTFGQGTKVEIK

SEQ ID NO: 6949 - DNA, 255 bp, Artificial Sequence
  Description of Artificial Sequence: Synthetic polynucleotide
gaggtgcagctgctcgagtccgggggaggcgtggtccagcctgggaggtccctgagactctcctgtgcagcgtctggattcaccttcagtagatatggcatggattgggtccgccaggctccaggcaagggactggagtgggtggcagttatatggtatgatggaagtaataaatactatgcagactccgtgaagggccgattcaccatctccagagacaattccaagaatacgctgtatctgcaaatgaacagc

SEQ ID NO: 6950 - protein, 251 aa, Artificial Sequence
  Description of Artificial Sequence: Synthetic polypeptide
EVQLLESGGGVVQPGRSLRLSCAASGFTFSRYGMDWVRQAPGKGLEWVAVIWYDGSNKYYADSVKGRFTISRDNSKNTLYLQMNSLRAEDTAVYYCARNYGSGSYGAYYYHGMDVWGQGTTVTVSSGGGGSGGGGSGGGGSELALTQPASASGSPGQSITISCTGTSSDVGGYNYVSWYQQHPGKAPKLMIYEVSKRPSGVPDRFSGSKSGNTASLTVSGLQAEDEADYYCSSYAGSNNVVFGGGTKLTVL

SEQ ID NO: 6951 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctggagtgggtctcagctattagtggtagtggtagtagcacatactacgcagactccgtgaagggccggttcaccatctccagagacaattccaagaacacgctgtatctgcaaatgaacagc

SEQ ID NO: 6952 - protein, 243 aa, Artificial Sequence
  Description of Artificial Sequence: Synthetic polypeptide
EVQLLESGGGLVQPGGSLRLSCAASGFTFSSYAMSWVRQAPGKGLEWVSAISGSGSSTYYADSVKGRFTISRDNSKNTLYLQMNSLRAEDTAVYYCAKHLRYSDWPLDYWGQGTLVTVSSGGGGSGGGGSGGGGSELTLTQSPGTLSLSPGERATLSCRASQSVSSSYLAWYQQKPGQAPRLLIYGASSRATGIPARFSGSGSGTDFTLTISRLEPEDFAVYYCQQYGSSPLTFGGGTKLEIK

SEQ ID NO: 6953 - DNA, 255 bp, Artificial Sequence
  Description of Artificial Sequence: Synthetic polynucleotide
gaggtgcagctgctcgagtctggagctgaggtgaagaagcctggggcctcagtgaaggtctcctgcaaggcttctggatacaccttcaccagttatgatatcaactgggtgcgacaggccactggacaagggcttgagtggatgggatggatgaaccctaagagtggtaacacaggctatgcacagaagttccaggacagagtcaccatgaccaggaacacctccataagcacagcctacatggagctgagcagc

SEQ ID NO: 6954 - protein, 249 aa, Artificial Sequence
  Description of Artificial Sequence: Synthetic polypeptide
EVQLLESGAEVKKPGASVKVSCKASGYTFTSYDINWVRQATGQGLEWMGWMNPKSGNTGYAQKFQDRVTMTRNTSISTAYMELSSLRSDDTAVYYCVRGWGTYYYYGMDVWGQGTTVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVDIK

SEQ ID NO: 6955 - DNA, 255 bp, Artificial Sequence; identical to SEQ ID NO: 6857
  Description of Artificial Sequence: Synthetic polynucleotide

SEQ ID NO: 6956 - protein, 243 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDITYYADSVKGRFTISRDNSKNTLYLQMNSLRAEDTAVYYCAKHLRYFDWPLDYWGQGTLVTVSSGGGGSGGGGSGGGGSELVMTQSPGTLSLSPGERATLSCRASQSVSSSYLAWYQQKPGQAPRLLIYGASTRATGIPDRFSGSGSGTDFTLTISRLEPEDFAVYYCQQYGTSPLTFGGGTKVDIK

SEQ ID NO: 6957 - DNA, 255 bp, Artificial Sequence; identical to SEQ ID NO: 6879
  Description of Artificial Sequence: Synthetic polynucleotide

SEQ ID NO: 6958 - protein, 249 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDTSKNQFSLKLSSVTAADTAVYYCARGGGYSYGYDYGMDVWGQGTTVTVSSGGGGSGGGGSGGGGSELVMTQSPLSLPVIPGEPASISCRSSQSLLYSNGYNYLDWYLQKPGQSPQLLIYLGSKRASGVPDRFSGSGSGTDFTLKISRVEAEDVGVYYCMQVLQTPPTFGQGTKLDIK

SEQ ID NO: 6959 - DNA, 255 bp, Artificial Sequence
  Description of Artificial Sequence: Synthetic polynucleotide
gaggtgcagctgctcgagtcgggcccaggactggtgaagccttcggagaccctgtccctcacctgcattgtctctggtggctccatcagcagtagtaggtcctactggggctggatccgccagcccccagggaagggactggagtggattgggagtatctattatggtgggagcacctactacaacccgtccctcaagaatcgagtcaccatgtccgttgacacgtccaagaaccagttctccctgaagctgagc

SEQ ID NO: 6960 - protein, 249 aa, Artificial Sequence
  Description of Artificial Sequence: Synthetic polypeptide
EVQLLESGPGLVKPSETLSLTCIVSGGSISSSRSYWGWIRQPPGKGLEWIGSIYYGGSTYYNPSLKNRVTMSVDTSKNQFSLKLSSVTAADTAVYYCATTIFGVVGWFDPWGQGNLVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIK

SEQ ID NO: 6961 - DNA, 255 bp, Artificial Sequence
  Description of Artificial Sequence: Synthetic polynucleotide
gaggtgcagctgctcgagtctggtcctgcgctggtgaaacccacacagaccctcacgctgtcctgttccttctctgggttctcactcagcactaataaaatggctgtgggttggatccgtcagcccccaggaaaggccctggagtggcttgcactcatttattggaatgatgataagcgctacagtccatctctgaagagcaggctcaccatcaccaaggacacctccaaaaaccaggtggtccttacaatgacc

SEQ ID NO: 6962 - protein, 245 aa, Artificial Sequence
  Description of Artificial Sequence: Synthetic polypeptide
EVQLLESGPALVKPTQTLTLSCSFSGFSLSTNKMAVGWIRQPPGKALEWLALIYWNDDKRYSPSLKSRLTITKDTSKNQVVLTMTNMDPVDTATYYCARRRYNWNYENWFDPWGQGILVTVSSGGGGSGGGGSGGGGSELQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 6963 - DNA, 255 bp, Artificial Sequence
  Description of Artificial Sequence: Synthetic polynucleotide
gaggtgcagctgctcgagtctggtcctgtgctggtgaaacccacacagaccctcacgctgacctgcaccttctctggtttctcattcaccactcataaaatgggtgtggactggatccgtcagcccccaggaaaggccctggagtggcttgcactcatttattggaatgatgataagcgctacagcccatctctgcagagtaggctcaccatcaccaaggacacctccaaaaaccaggtggtcctcacaatgacc

SEQ ID NO: 6964 - protein, 245 aa, Artificial Sequence
  Description of Artificial Sequence: Synthetic polypeptide
EVQLLESGPVLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSELQMTQSPSSLSASVGDRVTITCRASQSISSYLNWYQQKPGKAPKLLIYATSSLQSGVPSRFSGSGSGTDFTLTISSLQPEDFATYYCQQSYSIPFTFGPGTKVEIK

SEQ ID NO: 6965 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcaggtattagtggtagtggtggtagctcatactacgcagactccgtgaagggccggttcaccatctccagagacaattccaagaacacgctgtatctgcaaatgaacagc

SEQ ID NO: 6966 - protein, 243 aa, Artificial Sequence
  Description of Artificial Sequence: Synthetic polypeptide
EVQLLESGGGLVQPGGSLRLSCAASGFTFSSYAMSWVRQAPGKGLEWVSGISGSGGSSYYADSVKGRFTISRDNSKNTLYLQMNSLRAEDTAVYYCAKTLTPDYYYDMDVWGQGTTVTVSSGGGGSGGGGSGGGGSELQMTQSPSSVSASVGDRVTITCQASQDISNYLNWYQQKPGKAPKLLIYAASSLQSGVPSRFSGSGSGTDFTLTISSLQPEDFATYYCQQSYSTPLTFGGGTKVDIK

SEQ ID NO: 6967 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccgtgagctgggtccgccaggctccagggaaggggctggagtgggtctcaggtattagtggtagtggtggtagcacatactacgcagactccgtgaagggccggttcaccatctccagagacaattccaagaacacgctgtatctgcaaatgaacagc

SEQ ID NO: 6968 - protein, 243 aa, Artificial Sequence
  Description of Artificial Sequence: Synthetic polypeptide
EVQLLESGGGLVQPGGSLRLSCAASGFTFSSYAVSWVRQAPGKGLEWVSGISGSGGSTYYADSVKGRFTISRDNSKNTLYLQMNSLRAEDTAVYYCAKALTPDYYYDMDVWGQGTTVTVSSGGGGSGGGGSGGGGSELQMTQSPSSLSASVGDRVTITCRASQGISNYLAWYQQKPGKVPNLLIYGASTLQLGVPSRFSGSGSGTDFTLTISSLQPEDVATYYCQKYYSAPFTFGPGTKVDIK

SEQ ID NO: 6969 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcaactatgccatgagctgggtccgccaggctccagggaaggggctggagtgggtctcagctattagtggtagtggtggtagtacatactacgcagactccgtgaagggccggttcaccatctccagagacaattccaagaacacgctgtatctgcaaatgaacagc

SEQ ID NO: 6970 - protein, 247 aa, Artificial Sequence
  Description of Artificial Sequence: Synthetic polypeptide
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCAKQGGIAAAYYYYDGMDVWGQGTTVTVSSGGGGSGGGGSGGGGSELQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKLEIK

SEQ ID NO: 6971 - DNA, 255 bp, Artificial Sequence
  Description of Artificial Sequence: Synthetic polynucleotide
gaggtgcagctgctcgagtccgggggaggcgtggtccagcctgggaggtccctgagactctcctgtgcagcgtctggattcaccttcagtagatatggcatggattgggtccgccaggctccaggcaagggactggagtgggtggcagttatatcatatgatggaagtaataaatactatgcagactccgtgaagggccgattcaccatctccagagacaattccaagaacacgctgtatctgcaaatgaacagc

SEQ ID NO: 6972 - protein, 251 aa, Artificial Sequence
  Description of Artificial Sequence: Synthetic polypeptide
EVQLLESGGGVVQPGRSLRLSCAASGFTFSRYGMDWVRQAPGKGLEWVAVISYDGSNKYYADSVKGRFTISRDNSKNTLYLQMNSLRAEDTAVYYCARNYGSGSYGAYYYYGMDVWGQGTTVTVSSGGGGSGGGGSGGGGSELVLTQLPSVSKGLRQTATLTCTGNSNNVGNQGAAWLQQHQGHPPKLLSYRNNNRPSGISERLSASRSGNTASLTITGLQPEDEADYYCSAWDSSLSAVVFGGGTKLTVL

SEQ ID NO: 6973 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttacctcctatgccatgagctgggtccgccaggctccagggaaggggctggagtgggtctcaactattagtcatagtggtggtagcacatactacgcagactccgtgaagggccggttcaccatctccagagacaattccaagaacacgctgtatctgcaaatgaacagc

SEQ ID NO: 6974 - protein, 248 aa, Artificial Sequence
  Description of Artificial Sequence: Synthetic polypeptide
EVQLLESGGGLVQPGGSLRLSCAASGFTFTSYAMSWVRQAPGKGLEWVSTISHSGGSTYYADSVKGRFTISRDNSKNTLYLQMNSLRAEDTAVYYCAKDGGSGWFPKLLHYGLDVWGQGTTVTVSSGGGGSGGGGSGGGGSELVMTQSPSSLSASVGDRVTITCQASQDISNYLNWYQQKPGKAPKLLIYAASSLQSGVPSRFSGSGSGTEFTLTISSLQPEDFATYYCQQSYSTPPTFGQGTKVDIK

SEQ ID NO: 6975 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcaccttgagcatctatggcatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagc

SEQ ID NO: 6976 - protein, 246 aa, Artificial Sequence
  Description of Artificial Sequence: Synthetic polypeptide
EVQLLESGGGLVQPGGSLRLSCAASGFTLSIYGMSWVRQAPGKGLEWVSAISGSGGSTYYADSVKGRFTISRDNSKNTLYLQMNSLRAEDTAVYYCAKGEGISARYYYYGMDVWGQGTTVTVSSGGGGSGGGGSGGGGSELVMTQSPSSLSASVGDRVTITCRASQSISSYLNWYQQKPGKAPKLLIYAASSLQSGVPSRFSGSGSGTDFTLTISSLQPEDFATYYCQQSYSVPPTFGQGTKVDIK

SEQ ID NO: 6977 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtgactccatcagcagtaatccttactactggagctggatccgccagctccccgggaagggcctggagtggattgggtacatctcttacagtgggagcaccttctacaacccgtccctcaagagtcgagttaccatatcagtagacacgtctaagaaccagttctccctgaatctgacc

SEQ ID NO: 6978 - protein, 253 aa, Artificial Sequence
  Description of Artificial Sequence: Synthetic polypeptide
EVQLLESGPGLVKPSQTLSLTCTVSGDSISSNPYYWSWIRQLPGKGLEWIGYISYSGSTFYNPSLKSRVTISVDTSKNQFSLNLTSVTAADTAVYYCARDRLWFGVLNYYYGMDVWGLGTTVTVSSGGGGSGGGGSGGGGSELVMTQSPLSLPVTPGEPASISCRSSQSLLHRNGYNYLDWYLQKPGQSPQLLIYLGSNRASGVPDRFSGSGSGTDFTLKISRVEAEDVGVYYCMQALQTPFTFGPGTKVDIK

SEQ ID NO: 6979 - DNA, 255 bp, Artificial Sequence
  Description of Artificial Sequence: Synthetic polynucleotide
gaggtgcagctgctcgagtcgggcccaggactggtgaagccttcggagaccctgtccctcacctgcactgtctctggtggcgccatcagcagtggtgattactactggagctggatccgccagcacccagggaagggcctggagtggattgggtacatcgataagagtgggagcacctactacaacccgtccctcaagagtcgagctaccatatcagtagacacgtctaaggaccagttctccctgaagctgacc

SEQ ID NO: 6980 - protein, 253 aa, Artificial Sequence
  Description of Artificial Sequence: Synthetic polypeptide
EVQLLESGPGLVKPSETLSLTCTVSGGAISSGDYYWSWIRQHPGKGLEWIGYIDKSGSTYYNPSLKSRATISVDTSKDQFSLKLTSLTAADTAVYYCAREKMWFGVLNYYYGMDVWGQGTTVTVSSGGGGSGGGGSGGGGSELVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVEIK

SEQ ID NO: 6981 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtggcgccatcagcagtggtgattactactggagctggatccgccagcacccagggaagggcctggagtggattgggtacatcgataagagtgggagcacctactacaacccgtccctcaagagtcgagttaccatatcagttgacacgtctaagaaccagttctccctgaatctgacc

SEQ ID NO: 6982 - protein, 253 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRVTISVDTSKNQFSLNLTSVTAADTAVYYCARDRLWFGVLNYYYGMDVWGQGTTVTVSSGGGGSGGGGSGGGGSELVMTQSPLSLPVTPGEPASISCRSSQSLLHSNGYNYVDWYLQKPGQSPQLLIYLGSNRASGVPDRFSGSGSGADFTLKISRVEAEDVGVYYCMQALQTPLTFGGGTKVEIK

SEQ ID NO: 6983 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtggcgccatcagcagtggtgattactactggagctggatccgccagcacccagggaagggcctggagtggattgggtacatcgataagagtgggagcacctactacaacccgtccctcaagagtcgagctaccatatcagtagacacgtctaaggaccagttctccctgaagctgagc

SEQ ID NO: 6984 - protein, 253 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKDQFSLKLSSVTAADTAVYYCARDQLWFGVLNYYYGMDVWGQGTTVTVSSGGGGSGGGGSGGGGSELVLTQSPGTLSLSPGERATLSCRSSQSLLHRNGYNYLDWYLQKPGQSPQLLIYLGSNRASGVPDRFSGSGSGTDFTLKISRVEAEDVGVYYCMQALQTPRTFGQGTKVEIK

SEQ ID NO: 6985 - DNA, 255 bp, Artificial Sequence
  Description of Artificial Sequence: Synthetic polynucleotide
gaggtgcagctgctcgagtctgggggaggcttggtaaagcctggggggtcccttagactctcctgtgcagcctctggattcactttcagtaacgcctggatgagctgggtccgccaggctccagggaaggggctggagtgggttggccgtattaaaggcaacacttatggtgggacaacagactacgctgcacccgtgaaaggcagattcaccatctcaagagatgattcaaaaaacacgctgtttctgcaaatg

SEQ ID NO: 6986 - protein, 249 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSNSGSYYNYFSVMDVWGQGTTVTVSSGGGGSGGGGSGGGGSELVMTQSPSSLSASVGDRVTITCQARQDISDYLNWFQQKPGRAPKLLIFAASSLQGGVPSRFSGSGSGTDFTLTISSLQPEDFATYYCQQTYSMPFTFGPGTKVDIK

SEQ ID NO: 6987 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcactttcagtaacgcctggatgagctgggtccgccaggctccagggaaggggctggagtgggttggccgtattaaaggcaacacttatggtgggacaacagactacgctgcacccgtgaaaggcagattcaccatctcaagagatgattcaaaaaacacgctgtttctgcaaatg

SEQ ID NO: 6988 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLFLQMNSLKTEDTAVYYCTTPSNSGSYYNYFSVMDVWGQGTTVTVSSGGGGSGGGGSGGGGSELVMTQSPSSLSASVGDRVTITCRTSQSINSYLNWFQQKPGKAPKLLIYAASSLQSGVPSRFSGSGSGTDFTLTISSLQPEDFATYYCQQSYSTPFTFGPGTKVDIK

SEQ ID NO: 6989 - DNA, 255 bp, Artificial Sequence; identical to SEQ ID NO: 6983
  Description of Artificial Sequence: Synthetic polynucleotide

SEQ ID NO: 6990 - protein, 253 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKDQFSLKLSSVTAADTAVYYCARDRLWFGVLNYYYGMDVWGPGTTVTVSSGGGGSGGGGSGGGGSELVMTQSPLSLPVTPGEPASISCRSSQSLLHSTGYNYLDWYLQKPGQSPQLLIYLGSNRASGVPDRFSGSGSGTDFTLKISRVEAGDVGFYYCMQALQTPRTFGQGTKLEIK

SEQ ID NO: 6991 - DNA, 255 bp, Artificial Sequence; identical to SEQ ID NO: 6983
  Description of Artificial Sequence: Synthetic polynucleotide

SEQ ID NO: 6992 - protein, 253 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKDQFSLKLSSVTAADTAVYYCARDQLWFGVLNYYYGMDVWGQGTTVTVSSGGGGSGGGGSGGGGSELVMTQTPLSLPVTPGEPASISCRSSQSLLHRNGYNYLDWYLHKPGQSPQLLIYLGSNRASGVPDRFIGSGSGTDFTLKISKVEAEDVGIYYCMQALQTPRTFGQGTKVEIK

SEQ ID NO: 6993 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtgactccatcagcagtaatccttactactggagctggatccgccagcacccagggaagggcctggagtggattgggtacatctctcacagtgggagcacttattacaatccgtccctcaagagtcgagtaaccatatcagtagacacgtctaagaatcagttctccctgaatctgacc

SEQ ID NO: 6994 - protein, 252 aa, Artificial Sequence
  Description of Artificial Sequence: Synthetic polypeptide
EVQLLESGPGLVKPSQTLSLTCTVSGDSISSNPYYWSWIRQHPGKGLEWIGYISHSGSTYYNPSLKSRVTISVDTSKNQFSLNLTSVTAADTAVYYCAREKMWFGVLNYYYGMDVWGLGTTVTVSSGGGGSGGGGSGGGGSELVLTQSPLSLPVTPGEPASISCRSSQSLLHRNGYHYLDWYLQKPGQSPQLLIYLGSNRASGVPDRFIGSGSGTDFTLEISRVEAEDVGVYYCMQALQTPSFGQGTKLEIK

SEQ ID NO: 6995 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtgactccatcagcagtaatccttactactggagctggatccgccagcacccagggaagggcctggagtggattgggtacatctctcacagtgggagcacttattacaatccgtccctcaagagtcgagtaaccatatcagtagacacgtctaagaatcagttctccctgaagctgacc

SEQ ID NO: 6996 - protein, 253 aa, Artificial Sequence
  Description of Artificial Sequence: Synthetic polypeptide
EVQLLESGPGLVKPSQTLSLTCTVSGDSISSNPYYWSWIRQHPGKGLEWIGYISHSGSTYYNPSLKSRVTISVDTSKNQFSLKLTSVTAADTAVYYCARDRLWFGVLNYYYGMDVWGLGTTVTVSSGGGGSGGGGSGGGGSELVLTQSPLSLPVTPGEPASISCRSSQSLLHRNGYNYLDWYLQKPGQSPQLLIYLGSNRASGVPDRFSGSGSGTDFTLKISRVEAEDVGVYYCMQALQTPFTFGPGTKVEIK

SEQ ID NO: 6997 - DNA, 255 bp, Artificial Sequence
  Description of Artificial Sequence: Synthetic polynucleotide
gaggtgcagctgctcgagtccgggggaggcttggtaaagcctggggggtcccttagactctcctgtgcagcctctggattcactttcagtaacgcctggatgagctgggtccgccaggctccagggaaggggctggagtgggttggccgtattaaaggcaacacttatggtgggacaacagactacgctgcacccgtgaaaggcagattcaccatctcaagagatgattcaaaaaacacgctgtttctgcaaatg

SEQ ID NO: 6998 - protein, 249 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSNSGSYYNYFSVMDVWGQGTTVTVSSGGGGSGGGGSGGGGSELVMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 6999 - DNA, 255 bp, Artificial Sequence; identical to SEQ ID NO: 6997
  Description of Artificial Sequence: Synthetic polynucleotide

SEQ ID NO: 7000 - protein, 249 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSYSGSYYNYFSVMDVWGQGTTVTVSSGGGGSGGGGSGGGGSELVMTQSPSSLSASVGDRVTITCRTSQSINSYLNWFQQKPGKAPKLLIFAASSLQSGVPSRFSGSGSGTDFTLTISSLQREDFATYYCQQSYSTPFTFGPGTKVDIK

SEQ ID NO: 7001 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcactttcagtaacgcctggatgagctgggtccgccaggctccagggaaggggctggagtgggttggccgtattaaaggcaacacttatggtgggacaacagactacgctgcacccgtgaaaggcagattcaccatctcaagagatgattcaaaaaacacgctgtttctgcaaatg

SEQ ID NO: 7002 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLFLQMNSLKTEDTAVYYCTTPSNSGSYYNYFSVMDVWGQGTTVTVSSGGGGSGGGGSGGGGSELQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKLEIK

SEQ ID NO: 7003 - DNA, 255 bp, Artificial Sequence
  Description of Artificial Sequence: Synthetic polynucleotide
gaggtgcagctgctcgagtcgggcccaggactggtgaagccttcggagaccctgaccctcacctgcactgtctctggtggctccatcagtagttactactggagctggatccggcagcccgccgggaagggactggagtggattgggcatatctataccagtgggagcaccaactacaacccctccctcaagagtcgagtcaccatgtcagtggactcgtccaagaaccagttctccctgaagctgacctctctg

SEQ ID NO: 7004 - protein, 250 aa, Artificial Sequence
  Description of Artificial Sequence: Synthetic polypeptide
EVQLLESGPGLVKPSETLTLTCTVSGGSISSYYWSWIRQPAGKGLEWIGHIYTSGSTNYNPSLKSRVTMSVDSSKNQFSLKLTSLTAADTAVYYCAREKMWFGVLNYYYGMDVWGQGTTVTVSSGGGGSGGGGSGGGGSELVLTQSPLSLPVTPGEPASISCRSSQSLLHRNGYNYLDWYLQKPGQSPQLLIYLGSNRASGVPDRFIGSGSGTDFTLEISRVEAEDVGVYYCMQALQTPSFGQGTKLEIK

SEQ ID NO: 7005 - DNA, 255 bp, Artificial Sequence; identical to SEQ ID NO: 6977
  Description of Artificial Sequence: Synthetic polynucleotide

SEQ ID NO: 7006 - protein, 253 aa, Artificial Sequence
  Description of Artificial Sequence: Synthetic polypeptide
EVQLLESGPGLVKPSQTLSLTCTVSGDSISSNPYYWSWIRQLPGKGLEWIGYISYSGSTFYNPSLKSRVTISVDTSKNQFSLNLTSVTAADTAVYYCARDRLWFGVLNYYYGMDVWGLGTTVTVSSGGGGSGGGGSGGGGSELVLTQSPLSLPVTPGEPASISCRSSQSLLHRNGYHYLDWYLQKPGQSPQLLIYLGSNRASGVPDRFSGSGSGTDFTLKISRVEAEDVGVYYCMQALQTPFTFGPGTKVEIK

SEQ ID NO: 7007 - DNA, 255 bp, Artificial Sequence; identical to SEQ ID NO: 6983
  Description of Artificial Sequence: Synthetic polynucleotide

SEQ ID NO: 7008 - protein, 253 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKDQFSLKLSSVTAADTAVYYCARDQLWFGVLNYYYGMDVWGQGTTVTVSSGGGGSGGGGSGGGGSELVMTQSPLSLPVTPGEPASISCRSSQSLLHSNGYNYLDWYLQKPGQSPQLLIYLGSNRASGVPDRFSGSGSGTDFTLKISRVEAEDVGFYYCMQALQTPRTFGQGTKVEIK

SEQ ID NO: 7009 - DNA, 255 bp, Artificial Sequence
  Description of Artificial Sequence: Synthetic polynucleotide
gaggtgcagctgctcgagtcgggcccaggactggtgaagcctacggagaccctgtccctcacctgcactgtctctggtggctccatcagtgatttcttctggagctggatccggcagcccccaggaaagggactggagtggattggatatatctattacagagggagcaccaactaccacccctccctcaagagtcgagtcaccatgtcagtggacacgtccaagaaccagttctccctgaagctgacctctctg

SEQ ID NO: 7010 - protein, 251 aa, Artificial Sequence
  Description of Artificial Sequence: Synthetic polypeptide
EVQLLESGPGLVKPTETLSLTCTVSGGSISDFFWSWIRQPPGKGLEWIGYIYYRGSTNYHPSLKSRVTMSVDTSKNQFSLKLTSLTAADTAVYYCAREKMWFGVLNYYYGMDVWGQGTTVTVSSGGGGSGGGGSGGGGSELVMTQTPLSLPVTPGEPASISCRSSQSLLHSNGYNYLDWYLQKPGQSPQLLIYLGSNRASGVPDRFSGSGSGTDFTLKISRVEAEDVGFYYCMQALQTPRTFGQGTKVEIK

SEQ ID NO: 7011 - DNA, 255 bp, Artificial Sequence; identical to SEQ ID NO: 6983
  Description of Artificial Sequence: Synthetic polynucleotide

SEQ ID NO: 7012 - protein, 253 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKDQFSLKLSSVTAADTAVYYCARDQLWFGVLNYYYGMDVWGQGTTVTVSSGGGGSGGGGSGGGGSELVMTQSPLSLPVTPGEPASISCRSSQSLLHRNGYNYLDWYLHKPGQSPQLLIYLGSNRASGVPDRFSGSGSGTDFTLKISRVEAEDVGVYYCMQALQTPRTFGQGTKVEIK

SEQ ID NO: 7013 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtgactccatcagcagtaatccttactactggagctggatccgccagcacccagggatgggcctggagtggattgggtacatctattacagtgggagcacctcctacaacccgtccctcaagagtcgagtcaccatgtcagtggactcgtccaagaaccagttctccctgaagctgacc

SEQ ID NO: 7014 - protein, 252 aa, Artificial Sequence
  Description of Artificial Sequence: Synthetic polypeptide
EVQLLESGPGLVKPSQTLSLTCTVSGDSISSNPYYWSWIRQHPGMGLEWIGYIYYSGSTSYNPSLKSRVTMSVDSSKNQFSLKLTSVTAADTAVYYCARDLLWFGKLNYYYGLDVWGQGTTVTVSSGGGGSGGGGSGGGGSELVMTQTPLSLPVTPGEPASISCRSSQSLLHRNGYNYLDWYLQKPGQSPQLLIYLGSNRASGVPDRFIGSGSGTDFTLKISRVEAEDVGVYYCMQALQTPSFGQGTKVEIK

SEQ ID NO: 7015 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtggcgccatcagcagtggtgattactactggagctggatccgccagcacccagggaagggcctggagtggattgggtacatcgataagagtgggagcacctactacaacccgtccctcaagagtcgagctaccatatcagtagacacgtctaagaaccagttctccctgaagctgagc

SEQ ID NO: 7016 - protein, 253 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKNQFSLKLSSVTAADTAVYYCARDLLWFGKLNYYYGLDVWGQGTTVTVSSGGGGSGGGGSGGGGSELVMTQTPLSLPVTPGEPASISCRSSQSLLHRNGYNYLDWYLQKPGQSPQLLIYLGSNRASGVPDRFSGSGSGTDFTLKISRVEAEDAGVYYCMQSLHLPPTFGGGTKLEIK

SEQ ID NO: 7017 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtggctccatcagcagtaatccttactactggagctggatccgccagcacccagggaagggcctggagtggattgggtacatctctcacagtgggagcacttattacaatccgtccctcaagagtcgagtaaccatatcagtagacacgtctaagaaccagttctccctgaatctgacc

SEQ ID NO: 7018 - protein, 253 aa, Artificial Sequence
  Description of Artificial Sequence: Synthetic polypeptide
EVQLLESGPGLVKPSQTLSLTCTVSGGSISSNPYYWSWIRQHPGKGLEWIGYISHSGSTYYNPSLKSRVTISVDTSKNQFSLNLTSVTAADTAVYYCAREKMWFGVLNYYYGMDVWGQGTTVTVSSGGGGSGGGGSGGGGSELVLTQSPLSLPVTPGEPASISCRSSQSLLHRNGYHYLDWYLQKPGQSPQLLIYLGSNRASGVPSRFSGSGSGTDFTLKISRVEAEDVGIYYCMQALQTPFTFGPGTKVEIK

SEQ ID NO: 7019 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtgactccatcagcagtaatccttactactggagctggatccgccagcacccagggaagggcctggagtggattgggtacatctcttacagtgggagcacctactacaacccgtccctcaagagtcgagttaccatatcagtagacacgtctaagaaccagttctccctgaatctgacc

SEQ ID NO: 7020 - protein, 253 aa, Artificial Sequence
  Description of Artificial Sequence: Synthetic polypeptide
EVQLLESGPGLVKPSQTLSLTCTVSGDSISSNPYYWSWIRQHPGKGLEWIGYISYSGSTYYNPSLKSRVTISVDTSKNQFSLNLTSVTAADTAVYYCARDRLWFGVLNYYYGMDVWGPGTTVTVSSGGGGSGGGGSGGGGSELVMTQSPLSLPVTPGEPASISCRSSQSLLHRNGYNYLDWYLQKPGQSPQLLIYLGSNRASGVPDRFSGSGSGTDFTLKISRVEAEDVGIYYCMQALQTPFTFGPGTKVEIK

SEQ ID NO: 7021 - DNA, 255 bp, Artificial Sequence; identical to SEQ ID NO: 7019
  Description of Artificial Sequence: Synthetic polynucleotide

SEQ ID NO: 7022 - protein, 253 aa, Artificial Sequence
  Description of Artificial Sequence: Synthetic polypeptide
EVQLLESGPGLVKPSQTLSLTCTVSGDSISSNPYYWSWIRQHPGKGLEWIGYISYSGSTYYNPSLKSRVTISVDTSKNQFSLNLTSVTAADTAVYYCARDRLWFGVLNYYYGMDVWGPGTTVTVSSGGGGSGGGGSGGGGSELVMTQSPLSLPVTPGEPASISCRSSQSLLHSTGYNYLDWYLQKPGQSPQLLIYLGSNRASGVPDRFSGSGSGTDFTLKISRVEAEDVGFYYCMQGLQTPRTFGQGTKLEIK

SEQ ID NO: 7023 - DNA, 255 bp, Artificial Sequence; identical to SEQ ID NO: 6985
  Description of Artificial Sequence: Synthetic polynucleotide

SEQ ID NO: 7024 - protein, 249 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSNGGSYYNYFSVMDVWGQGTTVTVSSGGGGSGGGGSGGGGSELVMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVEIK

SEQ ID NO: 7025 - DNA, 255 bp, Artificial Sequence
  Description of Artificial Sequence: Synthetic polynucleotide
gaggtgcagctgctcgagtcgggcccaggactggtgaagccttcggagaccctgtccctcacctgcactgtctctggtggctccatcagtaattactactggagctgggtccggcagcccgccgggaagggactggagtggattggtcatatctataccagtgggagcaccaacttcaacccctccctcaagagtcgagtcaccatgtcagtggacacgtccaagaaccagttctccctgaagctgacctctctg

SEQ ID NO: 7026 - protein, 251 aa, Artificial Sequence
  Description of Artificial Sequence: Synthetic polypeptide
EVQLLESGPGLVKPSETLSLTCTVSGGSISNYYWSWVRQPAGKGLEWIGHIYTSGSTNFNPSLKSRVTMSVDTSKNQFSLKLTSLTAADTAVYYCAREKMWFGVLNYYYGMDVWGQGTTVTVSSGGGGSGGGGSGGGGSELVMTQSPLSLPVTPGEPASISCRSSQSLLHSNGYNYLDWYLQKPGQSPQLLIYLGSNRASGVPDRFSGSGSGTDFTLKISRVEAEDVGIYYCMQALQTPRTFGQGTKVDIK

SEQ ID NO: 7027 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagc

SEQ ID NO: 7028 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7029 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagccatgccatgagctgggtccgccaggctccagggaaggggctggagtgggtctcagctattagtggtagtggtggtggcacttactacgcagactccgtgaagggccggttcaccatctccagagacaattccaagaacacgctgtatctgcaaatgaacagc

SEQ ID NO: 7030 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYYADSVKGRFTISRDNSKNTLYLQMNSLRAEDTAVYYCATGKGVHLNFDYWGQGTLVTVSSGGGGSGGGGSGGGGSELVLTQPPSVSVAPGQTARITCGGNNIGSKSVQWYQQKPGQAPVLVVYDDNDRPSGIPERFSGSNSGNTATLTISRVEAGDEADFYCQVWDSSSDHVVFGGGTKLTVL

SEQ ID NO: 7031 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcaactattagtggaagtggtggtggcacatactacgcagactccgtgaagggccggttcaccatctccagagacaattccaagaacacgctgtatctgcaaatgaacagc

SEQ ID NO: 7032 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSTISGSGGGTYYADSVKGRFTISRDNSKNTLYLQMNSLRAEDTAVYYCATGKGVHLGFDYWGQGTLVTVSSGGGGSGGGGSGGGGSELVVTQEPSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 7033 - DNA, 255 bp, Artificial Sequence
  Description of Artificial Sequence: Synthetic polynucleotide
gaggtgcagctgctcgagtctgggggaggcttggtgcagcctggggggtccctgagactctcctgtgcagcctctggattcacctttagcagctatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgaacagc

SEQ ID NO: 7034 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQLPSVSVAPGQTARITCGGNNIGSKSVHWHQQKPGQAPVMVVYDDNDRPSGIPERFSGSNSGNTATLTISRVEAGDEADYHCQVWDSSSDHVVFGGGTKLTVL

SEQ ID NO: 7035 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagccatgccatgagctgggtccgccaggctccagggaaggggctggagtgggtctcagctattagtggtagtggtggtggcacatacaacgcagactccgtgaagggccggttcaccatctccagagacaattccaagaacacgctgtatctgcaaatgaacagc

SEQ ID NO: 7036 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAAYYCVTGKGVHLGFDYWGQGTLVTVSSGGGGSGGGGSGGGGSELVLTQSSSVSVAPGQTARITCGGNNIGSKSVHWYQQKPGQAPVLVVYDDNDRPSGIPERFSGSNSGNTATLTISRVEAGDEADFYCQVWDSSSDHVVFGGGTKLTVL

SEQ ID NO: 7037 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgaacagc

SEQ ID NO: 7038 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVTPGQTARITCGGNNIGSKSVHWYQQKPGQAPVLVVYDDNDRPSGIPERFSGSNFGNTATLTISRVEAGDEADYYCQVWDSSSDHVVFGGGTKLTVL

SEQ ID NO: 7039 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagccatgccatgagctgggtccgccaggctccagggaaggggctggagtgggtctcagctattagtggtagtggtggtggcacatacaacgcagactccgtgaagggccggttcaccatctccagagacaattccaagaacacgctgtatctgcaaatgaacagc

SEQ ID NO: 7040 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAVYYCATGKGVHLGFDYWGQGTLVTVSSGGGGSGGGGSGGGGSELVLTQLPSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7041 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctagagtgggtctcagctattagtggtagtggtggtggcacatactacgcagactccgtgaaggcccggttcaccatctccagagacaattccaagaacacgctgtatctgcaaatgaacagc

SEQ ID NO: 7042 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKARFTISRDNSKNTLYLQMNSLRAEDTAVYYCATGKGVHLGFDYWGQGTLVTVSSGGGGSGGGGSGGGGSELMLTQPPSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 7043 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagtagctatgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagc

SEQ ID NO: 7044 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELMLTQPHSVSVAPGQTARITCGGNNIGSKSVHWYQQKPGQAPVLVVYDDNDRPSGIPERFSGSNFGNTATLTISRVEAGDEADYYCQVWDSSSDHVVFGGGTKLTVL

SEQ ID NO: 7045 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggcaggggctggagtgggtctcagctattagtggtagtggtggtggcacatactacgcagactccgtgaagggccggttcaccatctccagagacaattccaagaacacgctgtatctgcaaatgaacagc

SEQ ID NO: 7046 - protein, 242 aa, Artificial Sequence
  Description of Artificial Sequence: Synthetic polypeptide
EVQLLESGGGLVQPGGSLRLSCAASGFTFSSYAMSWVRQAPGQGLEWVSAISGSGGGTYYADSVKGRFTISRDNSKNTLYLQMNSLRAEDTAVYYCATGKGVHLGFDHWGQGTLVTVSSGGGGSGGGGSGGGGSELMLTQPHSVSVAPGQTARITCGGNNIGSKSVQWYQQKPGQAPVLVVYDDNDRPSGIPERFSGSNSGNTATLTISRVEAGDEADFYCQVWDSSSDHVVFGGGTKLTVL

SEQ ID NO: 7047 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgaactgggtccgccaggctccagggaaggggctggagtgggtctcagctattagtggtagtggtggtggcacttactacgcagactccgtgaagggccggttcaccatctccagagacaattccaagaacacgctgtatctgcaaatgaacagc

SEQ ID NO: 7048 - protein, 242 aa, Artificial Sequence
  Description of Artificial Sequence: Synthetic polypeptide
EVQLLESGGGLVQPGGSLRLSCAASGFTFSSYAMNWVRQAPGKGLEWVSAISGSGGGTYYADSVKGRFTISRDNSKNTLYLQMNSLRAEDTAVYYCATGKGVHLNFDYWGQGTLVTVSSGGGGSGGGGSGGGGSELMLTQPHSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 7049 - DNA, 255 bp, Artificial Sequence; identical to SEQ ID NO: 7037
  Description of Artificial Sequence: Synthetic polynucleotide

SEQ ID NO: 7050 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVQWYQQKPGQAPVLVVYDDNDRPSGIPERFSGSNFGNTATLIISRVEAGDEADFYCQVWDSSSDHVVFGGGTKLTVL

SEQ ID NO: 7051 - DNA, 255 bp, Artificial Sequence
  Description of Artificial Sequence: Synthetic polynucleotide
gaggtgcagctgctcgagtctgggggagacttggtacagcctggggggtccctgagactctcctgtgcagcctctggattcacctttagcagccatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgaacagc

SEQ ID NO: 7052 - protein, 242 aa, Artificial Sequence
  Description of Artificial Sequence: Synthetic polypeptide
EVQLLESGGDLVQPGGSLRLSCAASGFTFSSHAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYYCQVWDSSSDHAVFGGGTKLTVL

SEQ ID NO: 7053 - DNA, 255 bp, Artificial Sequence; identical to SEQ ID NO: 7037
  Description of Artificial Sequence: Synthetic polynucleotide

SEQ ID NO: 7054 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELMLTQPHSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 7055 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcaactattagtggtagtggtggtggcacatactacgcagactccgtgaagggccggttcaccatctccagagacaattccaagaacacgctgtatctgcaaatgaacagc

SEQ ID NO: 7056 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSTISGSGGGTYYADSVKGRFTISRDNSKNTLYLQMNSLRAEDTAVYYCATGKGVHLNFDYWGQGTLVTVSSGGGGSGGGGSGGGGSELVLTQPASVSVAPGQTARITCGGNNIGIKSVHWYQQKPGQAPVLVVYDDNDRPSGIPERFSGSNSGNTATLTISRVEAGDEADYYCQVWDSSSDHVVFGGGTKLTVL

SEQ ID NO: 7057 - DNA, 255 bp, Artificial Sequence; identical to SEQ ID NO: 7031
  Description of Artificial Sequence: Synthetic polynucleotide

SEQ ID NO: 7058 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSTISGSGGGTYYADSVKGRFTISRDNSKNTLYLQMNSLRAEDTAVYYCATGKGVHLGFDYWGQGTLVTVSSGGGGSGGGGSGGGGSELVLTQSSSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7059 - DNA, 255 bp, Artificial Sequence
  Description of Artificial Sequence: Synthetic polynucleotide
gaggtgcagctgctcgagtccgggggagacttggtacagcctggggggtccctgagactctcctgtgcagcctctggaatcacctttagcagctatgccatgagctgggtccgccaggctccagggaaggggctggagtgggtctcagctattagtggtagtggtggtggcacatactacgcagactccgggaagggccggttcaccatctccagagacaattccaagaacacgctgtatctgcaaatgaacagc

SEQ ID NO: 7060 - protein, 242 aa, Artificial Sequence
  Description of Artificial Sequence: Synthetic polypeptide
EVQLLESGGDLVQPGGSLRLSCAASGITFSSYAMSWVRQAPGKGLEWVSAISGSGGGTYYADSGKGRFTISRDNSKNTLYLQMNSLRAEDTAVYYCATGKGVHLGFDYWGQGTLVTVSSGGGGSGGGGSGGGGSELMLTQPHSVSVAPGQTARITCGGNNIGSKSVHWYQQKPGQAPVMVVYDDNDRPSGIPERFSGSNSGNTATLIISRVEAGDEADYYCQVWDSSSDHVVFGGGTKLTVL

SEQ ID NO: 7061 - DNA, 255 bp, Artificial Sequence
  Description of Artificial Sequence: Synthetic polynucleotide
gaggtgcagctgctcgagtccgggggagacttggtacagcctggggggtccctgagactctcctgtgcagcctctggattcacctttagcagctatgccatgagctgggtccgccaggctccagggaaggggctggagtgggtctcaactattagtggtagtggtggtggcacatactacgcagactccgtgaagggccggttcaccatctccagagacaattccaagaacacgctgtatctgcaaatgaacagc

SEQ ID NO: 7062 - protein, 242 aa, Artificial Sequence
  Description of Artificial Sequence: Synthetic polypeptide
EVQLLESGGDLVQPGGSLRLSCAASGFTFSSYAMSWVRQAPGKGLEWVSTISGSGGGTYYADSVKGRFTISRDNSKNTLYLQMNSLRAEDTAVYYCAPGKGVHLNFDYWGQGTLVTVSSGGGGSGGGGSGGGGSELALTQPASASVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7063 - DNA, 255 bp, Artificial Sequence; identical to SEQ ID NO: 7037
  Description of Artificial Sequence: Synthetic polynucleotide

SEQ ID NO: 7064 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQLSSVSVAPGQTARITCGGNNIGSKSVQWYQQKPGQSPVMVVYDDNDRPSGIPERFSGSNSGNTATLTISRVEAGDEADYHCQVWDSSSDHVIFGGGTKLTVL

SEQ ID NO: 7065 - DNA, 255 bp, Artificial Sequence
  Description of Artificial Sequence: Synthetic polynucleotide
gaggtgcagctgctcgagtctgggggagacttggtacagcctggggggtccctgagactctcctgtgcagcctctggattcacctttagcagctatgccatgagctgggtccgccaggctccagggaaggggctggagtgggtctcaactattagtggtagtggtggtggcacatactacgcagactccgtgaagggccggttcaccatctccagggacaattccaagaacacgctgtatctgcaaatgaacagc

SEQ ID NO: 7066 - protein, 242 aa, Artificial Sequence
  Description of Artificial Sequence: Synthetic polypeptide
EVQLLESGGDLVQPGGSLRLSCAASGFTFSSYAMSWVRQAPGKGLEWVSTISGSGGGTYYADSVKGRFTISRDNSKNTLYLQMNSLRAEDTAVYYCATGKGVHLNFDYWGQGTLVTVSSGGGGSGGGGSGGGGSELVVTQEPSVSVAPGQTARITCGGNNIGSKSVHWYQQKPGQAPVMVVYDDNDRPSGIPERFSGSNFGNTATLIISRVEAGDEADYYCQVWDSNSDHVVFGGGTKLTVL

SEQ ID NO: 7067 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgaactgggtccgccaggctccagggaaggggctggagtgggtctcagctattagtggtagtggtggtggcacttactacgcagactccgtgaagggccggttcaccatctccagagacaattccaagaacacgctgtatctgcaaatgaacagc

SEQ ID NO: 7068 - protein, 242 aa, Artificial Sequence
  Description of Artificial Sequence: Synthetic polypeptide
EVQLLESGGGLVQPGGSLRLSCAASGFTFSSYAMNWVRQAPGKGLEWVSAISGSGGGTYYADSVKGRFTISRDNSKNTLYLQMNSLRAEDTAVYYCATGKGVHLNFDYWGQGTLVTVSSGGGGSGGGGSGGGGSELMLTQPPSVSVAPGQTARITCGGNNIGSKSVHWYQQKPGQAPVLVVYDDNDRPSGIPERFSGSNSGNTATLTISRVEAGDEADYYCQVWDSSSDHVIFGGGTKLTVL

SEQ ID NO: 7069 - DNA, 255 bp, Artificial Sequence
  Description of Artificial Sequence: Synthetic polynucleotide
gaggtgcagctgctcgagtccgggggagacttggtacagcctggggggtccctgagactctcctgtgcagcctctggattcacctttggcagctatgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagc

SEQ ID NO: 7070 - protein, 242 aa, Artificial Sequence
  Description of Artificial Sequence: Synthetic polypeptide
EVQLLESGGDLVQPGGSLRLSCAASGFTFGSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYHCQVWDSSSDHVVFGGGTKLTVL

SEQ ID NO: 7071 - DNA, 255 bp, Artificial Sequence; identical to SEQ ID NO: 7043
  Description of Artificial Sequence: Synthetic polynucleotide

SEQ ID NO: 7072 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVQWYQQKPGQAPVLVVYDDNDRPSGIPERFSGSNFGNTATLIISRVEAGDEADYYCQVWDSSSDHVVFGGGTKLTVL

SEQ ID NO: 7073 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgagcagc

SEQ ID NO: 7074 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMSSLRAEDTAVYYCATGKGVHLGFDYWGQGTLVTVSSGGGGSGGGGSGGGGSELVLTQPASVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7075 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtggcacatactacgcagactccgtgaaggcccggttcaccatctccagagacaattccaagaacacgctgtatctgcaaatgaacagc

SEQ ID NO: 7076 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKARFTISRDNSKNTLYLQMNSLRAEDTAVYYCATGKGVHLGFDYWGQGTLVTVSSGGGGSGGGGSGGGGSELMLTQPHSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 7077 - DNA, 255 bp, Artificial Sequence
  Description of Artificial Sequence: Synthetic polynucleotide
gaggtgcagctgctcgagtccgggggagacttggtacagcctggggggtccctgagactctcctgtgcagcctctggattcacctttagcagctatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgaacagc

SEQ ID NO: 7078 - protein, 242 aa, Artificial Sequence
  Description of Artificial Sequence: Synthetic polypeptide
EVQLLESGGDLVQPGGSLRLSCAASGFTFSSYAMSWVRQAPGKGLEWVSAISGSGGGTYYADSVKGRFTISRDNSKNTLYLQMNSLRAEDTAVYYCATGKGVHLNFDYWGQGTLVTVSSGGGGSGGGGSGGGGSELVLTQSPSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7079 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcagctattagtggtagtggtggtggcacatactacgcagactccgtgaagggccgattcaccatctccagagacaattccaagaacacgctgtatctgcaaatgaacagc

SEQ ID NO: 7080 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLNFDYWGQGTLVTVSSGGGGSGGGGSGGGGSELALTQPPSVSVAPGQTARITCGGNNIGSKSVHWYQQKPGQAPVLVVYDDNDRPSGIPERFSGSNSGNTATLTISRVEAGDEADYYCQVWDSSSDHVMFGGGTKLTVL

SEQ ID NO: 7081 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctccggattcacctttagcagctatgccatgagctgggtccgccaggctccagggaaggggctggagtgggtctcaactattagtggtagtggtggtggcacatactacgcagactccgtgaagggccggttcaccatctccagagacaattccaagaacacgctgtatctgcaaatgaacagc

SEQ ID NO: 7082 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSTISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNFGNTATLIISRVEAGDEADYYCQVWDSSSDHVVFGGGTKLTVL

SEQ ID NO: 7083 - DNA, 255 bp, Artificial Sequence
  Description of Artificial Sequence: Synthetic polynucleotide
gaggtgcagctgctcgagtctgggggagacttggtacagcctggggggtccctgagactctcctgtgcagcctctggattcacctttagcagctatgccatgcactgggtccgccaggctccggggcaggggctggagtgggtctcagctattagtggaagtggtggtggcacatactacgcagactccgtgaagggccggttcaccatctccagagacaattccaagaacacgctgtatctgcaaatgaacagc

SEQ ID NO: 7084 - protein, 242 aa, Artificial Sequence
  Description of Artificial Sequence: Synthetic polypeptide
EVQLLESGGDLVQPGGSLRLSCAASGFTFSSYAMHWVRQAPGQGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWHQQKPGQAPVLVVYDDNDRPSGIPERFSGSNFGNTATLIISRVEAGDEADYYCQVWDSSSDHVVFGGGTKLTVL

SEQ ID NO: 7085 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgacctgggtccgccaggctccagggaaggggctggagtgggtctcagctattagtggtagtggtggtggcacttactacgcagactccgtgaagggccggttcaccatctccagagacaattccaagaacacgctgtatctgcaaatgagcagc

SEQ ID NO: 7086 - protein, 242 aa, Artificial Sequence
  Description of Artificial Sequence: Synthetic polypeptide
EVQLLESGGGLVQPGGSLRLSCAASGFTFSSYAMTWVRQAPGKGLEWVSAISGSGGGTYYADSVKGRFTISRDNSKNTLYLQMSSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7087 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcagctattagtggtagtggtggtggcacatacaacgcagactccgtgaagggccggttcaccatctccagagacaattccaagaacacgctgtatctgcaaatgaacagc

SEQ ID NO: 7088 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYNADSVKGRFTISRDNSKNTLYLQMNSLRAEDTAAYYCVTGKGVHLGFDYWGQGTLVTVSSGGGGSGGGGSGGGGSELVLTQPASVSVAPGQTARITCGGNNIGSKSVHWYQQKPGQAPVMVVYDDNDRPSGIPERFSGSNFGNTATLIISRVEAGDEADYYCQVWDSSSDHVVFGGGTKLTVL

SEQ ID NO: 7089 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgaacagc

SEQ ID NO: 7090 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELALTQPASASVAPGQTARISCGGNNIGSKGVQWYQQKPGQAPVLVVYDDNDRPSGIPERFSGSNFGNTATLIISRVEAGDEADYYCQVWDSSSDHVVFGGGTKLTVL

SEQ ID NO: 7091 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctagagtgggtctcagctattagtggtagtggtggtggcacatactacgcagactccgtgaaggcccggttcaccatctccagagacaattccaagaacacgctgtatctgcaaatgaacagc

SEQ ID NO: 7092 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKARFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVQWYQQKPGQAPVLVVYDDNDRPSGIPERFSGSNFGNTATLIISRVEAGDEADYYCQVWDSSSDHVVFGGGTKLTVL

SEQ ID NO: 7093 - DNA, 255 bp, Artificial Sequence; identical to SEQ ID NO: 7035
  Description of Artificial Sequence: Synthetic polynucleotide

SEQ ID NO: 7094 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAAYYCVTGKGVHLGFDYWGQGTLVTVSSGGGGSGGGGSGGGGSELVVTQEPSVSVAPGQTARITCGGNNIGSKSVHWHQQKPGQAPVLVVYDDNDRPSGIPERFSGSNSGNTATLTISRVEAGDEADFYCQVWDSSSDHVVFGGGTKLTVL

SEQ ID NO: 7095 - DNA, 255 bp, Artificial Sequence
  Description of Artificial Sequence: Synthetic polynucleotide
gaggtgcagctgctcgagtccgggggaggcgtggtccagcctgggaggtccctgagactctcctgtgcagcctctggattcaccttcagtacctatggcatgcactgggtccgccaggctccaggcaaggggctggaatgggtggcagttatatcatatgatggaagtaataaatactatgcagactccgtgaagggccgattcaccatctccagagacgattccaagaacacgctgtatctgcaaatgaacagc

SEQ ID NO: 7096 - protein, 238 aa, Artificial Sequence
  Description of Artificial Sequence: Synthetic polypeptide
EVQLLESGGGVVQPGRSLRLSCAASGFTFSTYGMHWVRQAPGKGLEWVAVISYDGSNKYYADSVKGRFTISRDDSKNTLYLQMNSLRAEDTAVYYCARGQLLTGYWGQGTLVTVSSGGGGSGGGGSGGGGSELVMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVEIK

SEQ ID NO: 7097 - DNA, 255 bp, Artificial Sequence
  Description of Artificial Sequence: Synthetic polynucleotide
gaggtgcagctgctcgagtctggagcagaggtgaaaaagcctggggcctcagtgaaggtctcctgcaaggcttctggttacacctttaccaggaatggtctcagctgggtgcgacaggcccctggacaagggcttgagtggatgggatggatcagcggttacaatggtgacacaaactatgcacagaagctccagggcagaggcaccatgaccacagacacatccacgagcacagcctacatggagctgaggagc

SEQ ID NO: 7098 - protein, 238 aa, Artificial Sequence
  Description of Artificial Sequence: Synthetic polypeptide
EVQLLESGAEVKKPGASVKVSCKASGYTFTRNGLSWVRQAPGQGLEWMGWISGYNGDTNYAQKLQGRGTMTTDTSTSTAYMELRSLRSDDTAVYYCARGRATFDYWGQGTLVTVSSGGGGSGGGGSGGGGSELVMTQSPSSLSASVGDRVTITCRASQGISNYLAWYQQKPGKVPKLLISAASTLQSGVPSRFSGSGSGTDFTLTISSLQPEDVATYYCQKYNSAPFTFGPGTKLEIK

SEQ ID NO: 7099 - DNA, 255 bp, Artificial Sequence; identical to SEQ ID NO: 7097
  Description of Artificial Sequence: Synthetic polynucleotide

SEQ ID NO: 7100 - protein, 238 aa, Artificial Sequence
  Description of Artificial Sequence: Synthetic polypeptide
EVQLLESGAEVKKPGASVKVSCKASGYTFTRNGLSWVRQAPGQGLEWMGWISGYNGDTNYAQKLQGRGTMTTDTSTSTAYMELRSLRSDDTAVYYCARGRATFDYWGQGTLVTVSSGGGGSGGGGSGGGGSELVMTQSPSSLSASVGDRVTITCRASQGISNYLAWYQQKPGKVPKLLISAASTLQSGVPSRFSGSGSGTDFTLTISSLQPEDVATYYCQKYNSAPFTFGPGTKVDIK

SEQ ID NO: 7101 - DNA, 255 bp, Artificial Sequence
  Description of Artificial Sequence: Synthetic polynucleotide
gaggtgcagctgctcgagtccgggggaggcttggtaaagcctggggggtccctgagactctcctgtgcagcctctggattcaccttcagtgactactacatgagctggatccgccaggctccagggaaggggctggagtgggtttcatacattagtaaaagtggtagtaccatatactacgcagactctgtgaagggccgattcaccatctccagggacaacgccaagaactcactgtatctgcaaatgaacagc

SEQ ID NO: 7102 - protein, 241 aa, Artificial Sequence
  Description of Artificial Sequence: Synthetic polypeptide
EVQLLESGGGLVKPGGSLRLSCAASGFTFSDYYMSWIRQAPGKGLEWVSYISKSGSTIYYADSVKGRFTISRDNAKNSLYLQMNSLRAEDTAVYYCATYNYGHFDYWGQGTLVTVSSGGGGSGGGGSGGGGSELVLTQPPSVSVAPGQTARITCGGNNIGSKSVHWYQQKPGQAPVLVVYDDSDRPSGIPERFSGSNSGNTATLTISRVEAGDEADYYCQVWDSSSDHHVVFGGGTKLTVL

SEQ ID NO: 7103 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagccatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgaacagc

SEQ ID NO: 7104 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7105 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagccatgccatgagctgggtccgccaggctccagggaaggggctggagtgggtctcagctattagtggtagtggtggtggcacatactacgcagactccgtgaaggcccggttcaccatctccagagacaattccaagaacacgctgtatctgcaaatgaacagc

SEQ ID NO: 7106 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYYADSVKARFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWHQQKPGQAPVLVVYDDNDRPSGIPERFSGSNSGNTATLTISRVEAGDEADFYCQVWDSSSDHVVFGGGTKLTVL

SEQ ID NO: 7107 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctccggattcacctttagcagctatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgaacagc

SEQ ID NO: 7108 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLNFDYWGQGTLVTVSSGGGGSGGGGSGGGGSELVLTQPSSVSVAPGQTARITCGGNNIGSKSVHWYQQKPGQAPVLVVYDDNDRPSGIPERFSGSNFGNTATLIISRVAAGDEADYYCQVWDSSSDHVVFGGGTKLTVL

SEQ ID NO: 7109 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtggcacatactacgcagactccgtgaagggccggttcaccatctccagagacaattccaagaacacgctgtatctgcaaatgaacagc

SEQ ID NO: 7110 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAAYYCVTGKGVHLGFDYWGQGTLVTVSSGGGGSGGGGSGGGGSELVLTQPPSVSVAPGQTARITCGGNNIGSKSVHWHQQKPGQSPVLVIYDDNDRPSGIPERFSGFNSGNTATLTISRVEAGDEADYYCQVWDSSSDHVVFGGGTKLTVL

SEQ ID NO: 7111 - DNA, 255 bp, Artificial Sequence; identical to SEQ ID NO: 7035
  Description of Artificial Sequence: Synthetic polynucleotide

SEQ ID NO: 7112 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAAYYCVTGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYYCQVWDSSSDHVIFGGGTKLTVL

SEQ ID NO: 7113 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagctatgccatgagctgggtccgccaggctccagggaaggggctggagtgggtctcaactattagtggaagtggtggtggcacatactacgcagactccgtgaagggccggttcaccatctccagagacaattccaagaacacgctgtatctgcaaatgaacagc

SEQ ID NO: 7114 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSTISGSGGGTYYADSVKGRFTISRDNSKNTLYLQMNSLRAEDTAVYYCATGKGVHLGFDYWGQGTLVTVSSGGGGSGGGGSGGGGSELMLTQPHSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 7115 - DNA, 255 bp, Artificial Sequence
  Description of Artificial Sequence: Synthetic polynucleotide
gaggtgcagctgctcgagtccgggggaggcttggtaaagcctggggggtccctgagactctcctgtgcagcctctggattcacctttagcagctatgccatgaactgggtccgccaggctccagggaaggggctggagtgggtctcagctattagtggtagtggtggtggcacatactacgcagactccgggaagggccggttcaccatctccagagacaattccaagaacacgctgtatctgcaaatgaacagc

SEQ ID NO: 7116 - protein, 242 aa, Artificial Sequence
  Description of Artificial Sequence: Synthetic polypeptide
EVQLLESGGGLVKPGGSLRLSCAASGFTFSSYAMNWVRQAPGKGLEWVSAISGSGGGTYYADSGKGRFTISRDNSKNTLYLQMNSLRAEDTAVYYCATGKGVHLNFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 7117 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagcagccatgccatgagctgggtccgccaggctccagggcaggggctggagtgggtctcgtctattagtggtagcggtggtggcacatactacgcagcctccgtgaagggccggttcaccatctccagagacaattccaagaacacgctgtatctgcaaatgaacagc

SEQ ID NO: 7118 - protein, 242 aa, Artificial Sequence
  Description of Artificial Sequence: Synthetic polypeptide
EVQLLESGGGLVQPGGSLRLSCAASGFTFSSHAMSWVRQAPGQGLEWVSSISGSGGGTYYAASVKGRFTISRDNSKNTLYLQMNSLRAEDTAVYYCATGKGVHLNFDYWGQGTLVTVSSGGGGSGGGGSGGGGSELALTQPASASVAPGQTARITCGGNNIGSKSVHWHQQKPGQAPVLVVYDDNDRPSGIPERFSGSNSGNTATLTISRVEAGDEADFYCQVWDSSSDHVVFGGGTKLTVL

SEQ ID NO: 7119 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagctatgccatgagctgggtccgccaggctccagggaaggggctggagtgggtctcagctattagtggaagtggtggtggcacatactacgcagactccgtgaagggccggttcaccatctccagagacaattccaagaacacgctgtatctgcaaatgagcagc

SEQ ID NO: 7120 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMSSLRAEDTAVYYCATGKGVHLGFDYWGQGTLVTVSSGGGGSGGGGSGGGGSELVLTQPPSVSVAPGQTARITCGGNNIGSKSVHWHQQKPGQAPVLVVYDDNDRPSGIPERFSGSNSGNTATLTISRVEAGDEADYYCQVWDYSSDHVVFGGGTKLTVL

SEQ ID NO: 7121 - DNA, 255 bp, Artificial Sequence; identical to SEQ ID NO: 7031
  Description of Artificial Sequence: Synthetic polynucleotide

SEQ ID NO: 7122 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSTISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWHQQKPGQAPVLVVYDDNDRPSGIPERFSGSNSGNTATLTISRVEAGDEADYYCQVWDYSSDHVVFGGGTKLTVL

SEQ ID NO: 7123 - DNA, 255 bp, Artificial Sequence
  Description of Artificial Sequence: Synthetic polynucleotide
gaggtgcagctgctcgagtctgggggaggcgtggtccagcctgggaggtccctgagactctcctgtgcagcgtctggattcacctttagcagctatgccatgacctgggtccgccaggctccagggcaggggctggagtgggtctcgtctattagtggtagtggtggtggcacatactacgcagcctccgtgaagggccggttcaccatctccagagacaattccaagaacacgctgtatctgcaaatgaacagc

SEQ ID NO: 7124 - protein, 242 aa, Artificial Sequence
  Description of Artificial Sequence: Synthetic polypeptide
EVQLLESGGGVVQPGRSLRLSCAASGFTFSSYAMTWVRQAPGQGLEWVSSISGSGGGTYYAASVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVLVVYDDNDRPSGIPERFSGSNFGNTATLIISRVAAGDEADYYCQVWDSSSDHVVFGGGTKLTVL

SEQ ID NO: 7125 - DNA, 255 bp, Artificial Sequence; identical to SEQ ID NO: 7039
  Description of Artificial Sequence: Synthetic polynucleotide

SEQ ID NO: 7126 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAAYYCVTGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 7127 - DNA, 255 bp, Artificial Sequence
  Description of Artificial Sequence: Synthetic polynucleotide
gaggtgcagctgctcgagtcgggcccaggactggtgaagccttcggagaccctgtccctcacctgcactgtctctggtgactccatcagtagtagtcgttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagc

SEQ ID NO: 7128 - protein, 249 aa, Artificial Sequence
  Description of Artificial Sequence: Synthetic polypeptide
EVQLLESGPGLVKPSETLSLTCTVSGDSISSSRYYWGWIRQPPGKGLEWIGSIYYSGSTYYNPSLKSRVTISVDTSKNQFSLKLSSVTAADTAVYYCARGIFGVITYFDYWGQGTLVTVSSGGGGSGGGGSGGGGSELVMTQSPDSLAVSLGERATINCKSSQSVLYSSNNKNYLAWYQQKPGQPPKLLIYWASTRESGVPDRFSGSGSGTDFTLTISSLQAEDVAVYYCQQFYSTPITFGQGTRLEIK

SEQ ID NO: 7129 - DNA, 255 bp, Artificial Sequence; identical to SEQ ID NO: 7127
  Description of Artificial Sequence: Synthetic polynucleotide

SEQ ID NO: 7130 - protein, 249 aa, Artificial Sequence
  Description of Artificial Sequence: Synthetic polypeptide
EVQLLESGPGLVKPSETLSLTCTVSGDSISSSRYYWGWIRQPPGKGLEWIGSIYYSGSTYYNPSLKSRVTISVDTSKNQFSLKLSSVTAADTAVYYCARGIFGVITYFDYWGQGTLVTVSSGGGGSGGGGSGGGGSELVMTQTPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 7131 - DNA, 255 bp, Artificial Sequence
  Description of Artificial Sequence: Synthetic polynucleotide
gaggtgcagctgctcgagtctggtcctgtgctggtgaaacccacacagaccctcacgctgacctgcaccttctctggtttctcattcaccactcataaaatgggtgtggactggatccgtcagcccccaggaaaggccctggagtggcttgcactcatttattggaatgatgataagcgctacaacccatctctgcagagtaggctcaccatcaccaaggacacctccaaaaaccaggtggtcctcacaatgacc

SEQ ID NO: 7132 - protein, 245 aa, Artificial Sequence
  Description of Artificial Sequence: Synthetic polypeptide
EVQLLESGPVLVKPTQTLTLTCTFSGFSFTTHKMGVDWIRQPPGKALEWLALIYWNDDKRYNPSLQSRLTITKDTSKNQVVLTMTNMDPVDTATYYCAYRRYNWNYENWFDPWGQGTLVTVSSGGGGSGGGGSGGGGSELVMTQSPSSLSASVGDRVTITCRASQSISNYFNWYQQKPGKAPKLLIYAASSLQSGVPSRFSGSGSGTDFTLTISSLQPEDFATYYCQQSYITPFTFGGGTKLEIK

SEQ ID NO: 7133 - DNA, 255 bp, Artificial Sequence
  Description of Artificial Sequence: Synthetic polynucleotide
gaggtgcagctgctcgagtctggtcctacgctggtgaaacccacacagaccctcacgctgacctgcaccttctctggtttctcattcaccactcataaaatgggtgtggactggatccgtcagcccccaggaaaggccctggagtggcttgcactcatttattggaatgatgataagcgctacagcccatctctgcagagtaggctcaccatcaccaaggacacctccaaaaaccaggtggtcctcacaatgacc

SEQ ID NO: 7134 - protein, 245 aa, Artificial Sequence
  Description of Artificial Sequence: Synthetic polypeptide
EVQLLESGPTLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSELQMTQSPSSLSASVGDRVTITCRASQFISSYLNWYQQKPGKAPKLLIYAASSLQSGVPSRFSGRGSGTDFTLTISSLQPEDFATYYCQQSYSTPFTFGPGTKVEIK

SEQ ID NO: 7135 - DNA, 255 bp, Artificial Sequence
  Description of Artificial Sequence: Synthetic polynucleotide
gaggtgcagctgctcgagtctggtcctatgctggtgaaacccacacagaccctcacgctgacctgcaccttctctggtttctcattcaccactcataaaatgggtgtggactggatccgtcagcccccaggaaaggccctggagtggcttgcactcatttattggaatgatgataagcgctacagcccatctctgcagagtaggctcaccatcaccaaggacacctccaaaaaccaggtggtcctcacaatgacc

SEQ ID NO: 7136 - protein, 245 aa, Artificial Sequence
  Description of Artificial Sequence: Synthetic polypeptide
EVQLLESGPMLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSELVMTQSPDSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 7137 - DNA, 255 bp, Artificial Sequence; identical to SEQ ID NO: 7135
  Description of Artificial Sequence: Synthetic polynucleotide

SEQ ID NO: 7138 - protein, 245 aa, Artificial Sequence
  Description of Artificial Sequence: Synthetic polypeptide
EVQLLESGPMLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSELQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVEIK

SEQ ID NO: 7139 - DNA, 255 bp, Artificial Sequence
  Description of Artificial Sequence: Synthetic polynucleotide
gaggtgcagctgctcgagtctggtcctgcgctggtgaaacccacacagaccctcacgctgacctgcaccttctctggtttctcattcaccactcataaaatgggtgtggactggatccgtcagcccccaggaaaggccctggagtggcttgcactcatttattggaatgatgataagcgctacagcccatctctgcagagtaggctcaccatcaccaaggacacctccaaaaaccaggtggtcctcacaatgacc

SEQ ID NO: 7140 - protein, 245 aa, Artificial Sequence
  Description of Artificial Sequence: Synthetic polypeptide
EVQLLESGPALVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSELQMTQSPSSLSASVGDRVTITCQASQDISNYLNWYQQKPGKAPKLLIYAASSLQSGVPSRFSGSGSGTDFTLTISSLQPEDFATYYCQQSYTTPFTFGPGTKVEIK

SEQ ID NO: 7141 - DNA, 255 bp, Artificial Sequence; identical to SEQ ID NO: 7135
  Description of Artificial Sequence: Synthetic polynucleotide

SEQ ID NO: 7142 - protein, 245 aa, Artificial Sequence
  Description of Artificial Sequence: Synthetic polypeptide
EVQLLESGPMLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSELVMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKLEIK

SEQ ID NO: 7143 - DNA, 255 bp, Artificial Sequence
  Description of Artificial Sequence: Synthetic polynucleotide
gaggtgcagctgctcgagtctgggggaggcttggtacagcctggggggtccctgagactctcctgtgcagcctctggattcacctttagctcctatgccatgagctgggtccgccaggctccagggagggggctggagtgggtctcaactattagtattagtggtggtagcacaaactacgcagactccgtgaagggccggttcaccatctccagagacaattccaagaacacgctgtatctgcaaatgaacagc

SEQ ID NO: 7144 - protein, 248 aa, Artificial Sequence
  Description of Artificial Sequence: Synthetic polypeptide
EVQLLESGGGLVQPGGSLRLSCAASGFTFSSYAMSWVRQAPGRGLEWVSTISISGGSTNYADSVKGRFTISRDNSKNTLYLQMNSLRAEDTAVYYCAKDGGSGWFPKLLHYGLDVWGQGTTVTVSSGGGGSGGGGSGGGGSELQMTQSPSSLSASVGDRVTITCQASQDISNYLNWYQQKPGKAPKLLIYAASSLQSGVPSRFSGSGSGTDFTLTISSLQPEDFATYYCQQSYSIPLTFGGGTKVEIK

SEQ ID NO: 7145 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcactttcagtaacgcctggatgagctgggtccgccaggctccagggaaggggctggagtgggttggccgtattaaaggcaacacttatggtgggacaacagactacgctgcacccgtgaaaggcagattcaccatctcaagagatgattcaaaaaacacgctgtatctgcaaatg

SEQ ID NO: 7146 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLYLQMNSLKTEDTAVYYCTTPSYSGSYYNYFSVMDVWGQGTTVTVSSGGGGSGGGGSGGGGSELVMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 7147 - DNA, 255 bp, Artificial Sequence
  Description of Artificial Sequence: Synthetic polynucleotide
gaggtgcagctgctcgagtctgggggaggcttggtacagcctggggggtcccttagactctcctgtgcagcctctggattcactttcagtaacgcctggatgagctgggtccgccaggctccagggaaggggctggagtgggttggccgtattaaaagcaaaacttatggtgggacaacagactacgctgcacccgtgaaaggcagattcaccatctcaagagatgattcaaaaaacacgctgtatctgcaaatg

SEQ ID NO: 7148 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKSKTYGGTTDYAAPVKGRFTISRDDSKNTLYLQMNSLKTEDTAVYYCTTPSYSGSYYNYFSVMDVWGQGTTVTVSSGGGGSGGGGSGGGGSELQMTQSPSSLSASVGDRVTITCRTSQSISSYLNWFQQKPGKAPKLLIFAASSLQSGVPSRFSGSGSGTDFTLTISSLQPEDFATYYCQQSYSSPFTFGPGTKVEIK

SEQ ID NO: 7149 - DNA, 255 bp, Artificial Sequence
  Description of Artificial Sequence: Synthetic polynucleotide
gaggtgcagctgctcgagtccgggggaggcttggtacagcctggggggtcccttagactctcctgtgcagcctctggattcactttcagtaacgcctggatgagctgggtccgccaggctccagggaaggggctggagtgggttggccgtattaaaggcaacacttatggtgggacaacagactacgctgcacccgtgaaaggcagattcaccatctcaagagatgattcaaaaaacacgctgtttctgcaaatg

SEQ ID NO: 7150 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLFLQMNSLKTEDTAVYYCTTPSNSGSYYNYFSVMDVWGQGTTVTVSSGGGGSGGGGSGGGGSELVMTQSPSSLSASVGDRVTITCRTSQSISSYLNWFQQKPGKAPKLLIFAASSLQSGVPSRFSGSGSGTDFTLTISSLQPEDFATYYCQQTYSMPFTFGPGTKVEIK

SEQ ID NO: 7151 - DNA, 255 bp, Artificial Sequence; identical to SEQ ID NO: 6997
  Description of Artificial Sequence: Synthetic polynucleotide

SEQ ID NO: 7152 - protein, 249 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSYSGSYYNYFSVMDVWGQGTTVTVSSGGGGSGGGGSGGGGSELQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 7153 - DNA, 255 bp, Artificial Sequence; identical to SEQ ID NO: 6987
  Description of Artificial Sequence: Synthetic polynucleotide

SEQ ID NO: 7154 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLFLQMNSLKTEDTAVYYCTTPSYSGSYYNYFSVMDVWGQGTTVTVSSGGGGSGGGGSGGGGSELVMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 7155 - DNA, 255 bp, Artificial Sequence; identical to SEQ ID NO: 6997
  Description of Artificial Sequence: Synthetic polynucleotide

SEQ ID NO: 7156 - protein, 249 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSYSGSYYNYFSVMDVWGQGTTVTVSSGGGGSGGGGSGGGGSELVMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 7157 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtgactccatcagcagtaatccttactactggagctggatccgccagcacccagggaagggcctggagtggattgggtacatctcttacagtgggatcaccaactacaacccctccctcaagagtcgagtcaccatgtcagtggacacgtccaagaaccagttctccctgaagctgacc

SEQ ID NO: 7158 - protein, 253 aa, Artificial Sequence
  Description of Artificial Sequence: Synthetic polypeptide
EVQLLESGPGLVKPSQTLSLTCTVSGDSISSNPYYWSWIRQHPGKGLEWIGYISYSGITNYNPSLKSRVTMSVDTSKNQFSLKLTSLTAADTAVYYCAREKMWFGVLNYYYGMDVWGQGTTVTVSSGGGGSGGGGSGGGGSELVMTQTPLSLPVTPGEPASISCRSSQSLLHRNGYNYLDWYLQKPGQSPQLLIYLGSNRASGVPDRFSGSGSGTDFTLKISRVEAGDVGVYYCMQALQTPWTFGQGTKVEIK

SEQ ID NO: 7159 - DNA, 255 bp, Artificial Sequence; identical to SEQ ID NO: 6977
  Description of Artificial Sequence: Synthetic polynucleotide

SEQ ID NO: 7160 - protein, 253 aa, Artificial Sequence
  Description of Artificial Sequence: Synthetic polypeptide
EVQLLESGPGLVKPSQTLSLTCTVSGDSISSNPYYWSWIRQLPGKGLEWIGYISYSGSTFYNPSLKSRVTISVDTSKNQFSLNLTSVTAADTAVYYCARDRLWFGVLNYYYGMDVWGLGTTVTVSSGGGGSGGGGSGGGGSELVMTQSPLSLPVTPGEPASISCRSSQSLLHSTGYNYVDWYLQKPGQSPQLLIYLGSNRASGVPDRFSGSGSGTDFTLKISRVEAEDVGFYYCMQALQTPRTFGQGTKVEIK

SEQ ID NO: 7161 - DNA, 255 bp, Artificial Sequence; identical to SEQ ID NO: 6987
  Description of Artificial Sequence: Synthetic polynucleotide

SEQ ID NO: 7162 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLFLQMNSLKTEDTAVYYCTTPSNSGSYYNYFSVMDVWGQGTTVTVSSGGGGSGGGGSGGGGSELVMTQSPSSLSASVGDRVTITCRTSQSISSYLNWYQQKPGKAPKLLIYAASSLQSGVPSRFSGSGSGTDFTLTISSLQPEDFATYYCQQTYSMPFTFGGGTKVEIK

SEQ ID NO: 7163 - DNA, 255 bp, Artificial Sequence
  Description of Artificial Sequence: Synthetic polynucleotide
gaggtgcagctgctcgagtctgggggaggcttggtgcagcctggggggtcccttagactctcctgtgcagcctctggattcactttcagtaacgcctggatgagctgggtccgccaggctccagggaaggggctggagtgggttggccgtattaaaggcaacacttatggtgggacaacagactacgctgcacccgtgaaaggcagattcaccatctcaagagatgattcaaaaaacacgctgtttctgcaaatg

SEQ ID NO: 7164 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLFLQMNSLKTEDTAVYYCTTPSYSGSYYNYFSVMDVWGQGTTVTVSSGGGGSGGGGSGGGGSELVMTQSPSSLSASVGDRVTITCRTSQSISSYLNWYQQKPGRAPKLLIFAASSLQGGVPSRFSGSGSGTDFTLTISSLQPEDFATYYCQQSYSSPFTFGPGTKVEIK

SEQ ID NO: 7165 - DNA, 255 bp, Artificial Sequence; identical to SEQ ID NO: 6985
  Description of Artificial Sequence: Synthetic polynucleotide

SEQ ID NO: 7166 - protein, 249 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSYSGSYYNYFSVMDVWGQGTTVTVSSGGGGSGGGGSGGGGSELVMTQSPSSLSASVGDRVTITCRTSQSISSYLNWYQQKPGRAPKLLIFAASSLQGGVPSRFSGSGSGTDFTLTISSLQPEDFATYYCQQTYSSPFTFGPGTKLEIK

SEQ ID NO: 7167 - DNA, 255 bp, Artificial Sequence; identical to SEQ ID NO: 6993
  Description of Artificial Sequence: Synthetic polynucleotide

SEQ ID NO: 7168 - protein, 253 aa, Artificial Sequence
  Description of Artificial Sequence: Synthetic polypeptide
EVQLLESGPGLVKPSQTLSLTCTVSGDSISSNPYYWSWIRQHPGKGLEWIGYISHSGSTYYNPSLKSRVTISVDTSKNQFSLNLTSVTAADTAVYYCARDRLWFGVLNYYYGMDVWGLGTTVTVSSGGGGSGGGGSGGGGSELVMTQSPLSLPVTPGEPASISCRSSQSLLHSSGYNYLDWYLQKPGQSPQLLIYLGSNRASGVPDRFSGSGSGTDFTLKISKVEAEDVGVYYCMQALQTPRTFGQGTKVDIK

SEQ ID NO: 7169 - DNA, 255 bp, Artificial Sequence; identical to SEQ ID NO: 6977
  Description of Artificial Sequence: Synthetic polynucleotide

SEQ ID NO: 7170 - protein, 253 aa, Artificial Sequence
  Description of Artificial Sequence: Synthetic polypeptide
EVQLLESGPGLVKPSQTLSLTCTVSGDSISSNPYYWSWIRQLPGKGLEWIGYISYSGSTFYNPSLKSRVTISVDTSKNQFSLNLTSVTAADTAVYYCARDRLWFGVLNYYYGMDVWGLGTTVTVSSGGGGSGGGGSGGGGSELVLTQSPLSLPVTPGEPASISCRSSQSLLHRNGYNYLDWYLQKPGQSPQLLIYLGSNRASGVPDRFSGSGSGTDFTLKISRVEAEDVGVYYCMQGLQTPFTFGPGTKVEIK

SEQ ID NO: 7171 - DNA, 255 bp, Artificial Sequence
  Description of Artificial Sequence: Synthetic polynucleotide
gaggtgcagctgctcgagtcgggcccaggactggtgaagccttcacagaccctgtccctcacctgcactgtctctggtggttccatcagcagtggtggttactactggagctggatccgccagcacccagggaagggcctggagtggattgggtacatctctcacagtgggagcacttattacaatccgtccctcaagagtcgagtaaccatatcagtagacacgtctaagaatcagttctccctgaatctgacc

SEQ ID NO: 7172 - protein, 252 aa, Artificial Sequence
  Description of Artificial Sequence: Synthetic polypeptide
EVQLLESGPGLVKPSQTLSLTCTVSGGSISSGGYYWSWIRQHPGKGLEWIGYISHSGSTYYNPSLKSRVTISVDTSKNQFSLNLTSVTAADTAVYYCAREKMWFGVLNYYYGMDVWGQGTTVTVSSGGGGSGGGGSGGGGSELVMTQTPLSLPVTPGEPASISCRSSQSLLHRNGYNYLDWYLQKPGQSPQLLIYLGSNRASGVPDRFIGSGSGTDFTLEISRVEAEDVGVYYCMQALQTPSFGQGTKVEIK

SEQ ID NO: 7173 - DNA, 255 bp, Artificial Sequence; identical to SEQ ID NO: 7145
  Description of Artificial Sequence: Synthetic polynucleotide

SEQ ID NO: 7174 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLYLQMNSLKTEDTAVYYCTTPSYSGSYYNYFSVMDVWGQGTTVTVSSGGGGSGGGGSGGGGSELVMTQSPSSLSASVGDRVTITCRASQSISSYLNWYQQKPGRAPKLLIFAASSLQGGVPSRFSGSGSGTDFTLTISSLQPEDFATYYCQQTYSMPFTFGPGTKLEIK

SEQ ID NO: 7175 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYAASVKGRFTISRDNSKNTLYLQMSSLRAEDTAVYYCVTGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVAAGDEADYYCQVWDYRYLSQVFGGGTKLTVL

SEQ ID NO: 7176 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYAASVKGRFTISRDNSKNTLYLQMSSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGGGTKLTVL

SEQ ID NO: 7177 - protein, 238 aa, Artificial Sequence
  Description of Artificial Sequence: Synthetic polypeptide
QVQLVESGGGVVQPGRSLRLSCAASGFTFSTYGMHWVRQAPGKGLEWVAVISYDAETVKYAESVKGRFTISRDNSKNTLYLQMNSLRAEDTAVYYCARGQLLTGYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVEIK

SEQ ID NO: 7178 - protein, 241 aa, Artificial Sequence
  Description of Artificial Sequence: Synthetic polypeptide
QVQLVESGGGLVKPGGSLRLSCAASGFTFSDYYMSWIRQAPGKGLEWVSYISKSSYTVTYADAVKGRFTISRDNAKNSLYLQMNSLRAEDTAVYYCATYNYGHFDYWGQGTLVTVSSGGGGSGGGGSGGGGSSYVLTQPPSVSVAPGQTARITCGGNNIGSKSVHWYQQKPGQAPVLVVYDDADRPSGIPERFSGSNSGNTATLTISRVEAGDEADYYCQVWDASAGYGVVFGGGTKLTVL

SEQ ID NO: 7179 - protein, 253 aa, Artificial Sequence
  Description of Artificial Sequence: Synthetic polypeptide
QVQLQESGPGLVKPSQTLSLTCTVSGDSISSNPYYWSWIRQHPGKGLEWIGYISYSGITNYNPSLKSRVTMSVDTSKNQFSLKLTSLTAADTAVYYCAREKMWFGVLNYYYGMDVWGQGTTVTVSSGGGGSGGGGSGGGGSDIVMTQTPLSLPVTPGEPASISCRSSQSLLHRSGYNYLDWYLQKPGQSPQLLIYLGSNRASGVPDRFSGSGSGTDFTLKISRVEAGDVGVYYCMQALQTPWTFGQGTKVEIK

SEQ ID NO: 7180 - protein, 249 aa, Artificial Sequence
  Description of Artificial Sequence: Synthetic polypeptide
QVQLQESGPGLVKPSETLSLTCTVSGDSISSSRYYWGWIRQPPGKGLEWIGSIYYSGSTYYNPSLKSRVTISVDTSKNQFSLKLSSVTAADTAVYYCARGIFGVITYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFYSTPITFGQGTRLEIK

SEQ ID NO: 7181 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSSISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGGGTKLTVL

SEQ ID NO: 7182 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSTISGSGGGTYYADSVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGGGTKLTVL

SEQ ID NO: 7183 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSTISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGGGTKLTVL

SEQ ID NO: 7184 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNAASVKGRFTISRDNSKNTLYLQMNSLRAEDTAAYYCVTGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYYSNRAVFGGGTKLTVL

SEQ ID NO: 7185 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMSSLRAEDTAVYYCVTGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVAAGDEADYYCQVWDYRYLSQVFGGGTKLTVL

SEQ ID NO: 7186 - protein, 242 aa, Artificial Sequence; identical to SEQ ID NO: 7175
  Description of Artificial Sequence: Synthetic polypeptide

SEQ ID NO: 7187 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMSSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGGGTKLTVL

SEQ ID NO: 7188 - protein, 242 aa, Artificial Sequence; identical to SEQ ID NO: 7176
  Description of Artificial Sequence: Synthetic polypeptide

SEQ ID NO: 7189 - protein, 249 aa, Artificial Sequence
  Description of Artificial Sequence: Synthetic polypeptide
EVQLVESGGGLVQPGGSLRLSCAASGFTFSNAWMSWVRQAPGKGLEWVGRIKSKTYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQSYSSPFTFGPGTKVEIK

SEQ ID NO: 7190 - protein, 245 aa, Artificial Sequence
  Description of Artificial Sequence: Synthetic polypeptide
QITLKESGPALVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYLNWYQQKPGKAPKLLIYAASSLQSGVPSRFSGRGSGTDFTLTISSLQPEDFATYYCQQSYYYPTLFGPGTKVEIK

SEQ ID NO: 7191 - protein, 245 aa, Artificial Sequence
  Description of Artificial Sequence: Synthetic polypeptide
QITLKESGPTLVKPTQTLTLTCTFSGFSFTTHKMGVDWIRQPPGKALEWLAGIHIYDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYFNWYQQKPGKAPKLLIYAASSLQSGVPSRFSGSGSGTDFTLTISSLQPEDFATYYCQQSYITPFTFGPGTKVEIK

SEQ ID NO: 7192 - protein, 245 aa, Artificial Sequence
  Description of Artificial Sequence: Synthetic polypeptide
QITLKESGPALVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYLNWYQQKPGKAPKLLIYAASSLQSGVPSRFSGSGSGTDFTLTISSLQPEDFATYYCQQSYFPVVEFGPGTKVEIK

SEQ ID NO: 7193 - protein, 245 aa, Artificial Sequence
  Description of Artificial Sequence: Synthetic polypeptide
QITLKESGPTLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSDIQMTQSPSSLSASVGDRVTITCQASQDISNYLNWYQQKPGKAPKLLIYAASSLQSGVPSRFSGRGSGTDFTLTISSLQPEDFATYYCQQSYTPPTTFGPGTKVEIK

SEQ ID NO: 7194 - protein, 249 aa, Artificial Sequence
  Description of Artificial Sequence: Synthetic polypeptide
EVQLVESGGGLVQPGGSLRLSCAASGFTFSNAWMSWVRQAPGKGLEWVGRIRSRSYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGGGTKVEIK

SEQ ID NO: 7195 - protein, 249 aa, Artificial Sequence
  Description of Artificial Sequence: Synthetic polypeptide
EVQLVESGGGLVQPGGSLRLSCAASGFTFSNAWMSWVRQAPGKGLEWVGRIKSKTYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCIQAYTSPFTFGPGTKLEIK

SEQ ID NO: 7196 - protein, 249 aa, Artificial Sequence
  Description of Artificial Sequence: Synthetic polypeptide
EVQLVESGGGLVQPGGSLRLSCAASGFTFSNAWMSWVRQAPGKGLEWVGRITSSRYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 7197 - protein, 249 aa, Artificial Sequence
  Description of Artificial Sequence: Synthetic polypeptide
EVQLVESGGGLVKPGGSLRLSCAASGFTFSNAWMSWVRQAPGKGLEWVGRILNNAYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 7198 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYVAPRHVFGGGTKLTVL

SEQ ID NO: 7199 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYVAPRHVFGGGTKLTVL

SEQ ID NO: 7200 - protein, 249 aa, Artificial Sequence
  Description of Artificial Sequence: Synthetic polypeptide
EVQLVESGGGLVQPGGSLRLSCAASGFTFSNAWMSWVRQAPGKGLEWVGRITSGIYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQSGVPSRFSGSGSGTDFTLTISSLQPEDFATYYCQQTYSMPFTFGPGTKVDIK

SEQ ID NO: 7201 - protein, 249 aa, Artificial Sequence
  Description of Artificial Sequence: Synthetic polypeptide
EVQLVESGGGLVQPGGSLRLSCAASGFTFSNAWMSWVRQAPGKGLEWVGRIRSRPYGGTTDYAAPVKGRFTISRDDSKNTLYLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSSPFTFGPGTKLEIK

SEQ ID NO: 7202 - protein, 238 aa, Artificial Sequence
  Description of Artificial Sequence: Synthetic polypeptide
QVQLVESGGGVVQPGRSLRLSCAASGFTFSTYGMHWVRQAPGKGLEWVAVISYDASNKYYAESVKGRFTISRDNSKNTLYLQMNSLRAEDTAVYYCARGQLLTGYWGQGTLVTVSSGGGGSGGGGSGGGGSDIQMTQSPSSLSASVGDRVTITCRASQGISNYLAWYQQKPGKVPKLLIYAASTLQSGVPSRFSGSGSGTDFTLTISSLQPEDFATYYCQKYNSAPFTFGPGTKVEIK

SEQ ID NO: 7203 - DNA, 51 bp, Artificial Sequence
  Description of Artificial Sequence: Synthetic oligonucleotide
aagtccagtcagagccttttatatagtagcaatcaaaagaactacttggcc

SEQ ID NO: 7204 - protein, 17 aa, Artificial Sequence
  Description of Artificial Sequence: Synthetic peptide
KSSQSLLYSSNQKNYLA

SEQ ID NO: 7205 - DNA, 30 bp, Artificial Sequence
  Description of Artificial Sequence: Synthetic oligonucleotide
agtgccagctcaaatgtaaattacatacac

SEQ ID NO: 7206 - protein, 10 aa, Artificial Sequence
  Description of Artificial Sequence: Synthetic peptide
SASSNVNYIH

SEQ ID NO: 7207 - DNA, 33 bp, Artificial Sequence
  Description of Artificial Sequence: Synthetic oligonucleotide
cgagcaagtgggaatattcacaattatttagct

SEQ ID NO: 7208 - protein, 11 aa, Artificial Sequence
  Description of Artificial Sequence: Synthetic peptide
RASGNIHNYLA

SEQ ID NO: 7209 - DNA, 48 bp, Artificial Sequence
  Description of Artificial Sequence: Synthetic oligonucleotide
aggtctagtcagagcctcctgtatagtaatggatacaactatgtggat

SEQ ID NO: 7210 - protein, 16 aa, Artificial Sequence
  Description of Artificial Sequence: Synthetic peptide
RSSQSLLYSNGYNYVD

SEQ ID NO: 7211 - DNA, 48 bp, Artificial Sequence
  Description of Artificial Sequence: Synthetic oligonucleotide
aggtctagtcagagcctcctgtatagtaatggataccactatttggat

SEQ ID NO: 7212 - protein, 16 aa, Artificial Sequence
  Description of Artificial Sequence: Synthetic peptide
RSSQSLLYSNGYHYLD

SEQ ID NO: 7213 - DNA, 48 bp, Artificial Sequence
  Description of Artificial Sequence: Synthetic oligonucleotide
aggtctagtcagagcctcctgtatagtaatggatacaactatttggat

SEQ ID NO: 7214 - protein, 16 aa, Artificial Sequence
  Description of Artificial Sequence: Synthetic peptide
RSSQSLLYSNGYNYLD

SEQ ID NO: 7215 - DNA, 36 bp, Artificial Sequence
  Description of Artificial Sequence: Synthetic oligonucleotide
agggccagtcagagtgttagcagcagctacttagcc

SEQ ID NO: 7216 - protein, 12 aa, Artificial Sequence
  Description of Artificial Sequence: Synthetic peptide
RASQSVSSSYLA

SEQ ID NO: 7217 - DNA, 36 bp, Artificial Sequence; identical to SEQ ID NO: 7215
  Description of Artificial Sequence: Synthetic oligonucleotide

SEQ ID NO: 7218 - protein, 12 aa, Artificial Sequence
  Description of Artificial Sequence: Synthetic peptide
RASQSVSSSYLA

SEQ ID NO: 7219 - DNA, 48 bp, Artificial Sequence; identical to SEQ ID NO: 7213
  Description of Artificial Sequence: Synthetic oligonucleotide

SEQ ID NO: 7220 - protein, 16 aa, Artificial Sequence
  Description of Artificial Sequence: Synthetic peptide
RSSQSLLYSNGYNYLD

SEQ ID NO: 7221 - DNA, 33 bp, Artificial Sequence
  Description of Artificial Sequence: Synthetic oligonucleotide
cgggcgagtcagggtattagcagctggttagcc

SEQ ID NO: 7222 - protein, 11 aa, Artificial Sequence
  Description of Artificial Sequence: Synthetic peptide
RASQGISSWLA

SEQ ID NO: 7223 - DNA, 48 bp, Artificial Sequence; identical to SEQ ID NO: 7213
  Description of Artificial Sequence: Synthetic oligonucleotide

SEQ ID NO: 7224 - protein, 16 aa, Artificial Sequence
  Description of Artificial Sequence: Synthetic peptide
RSSQSLLYSNGYNYLD

SEQ ID NO: 7225 - DNA, 36 bp, Artificial Sequence; identical to SEQ ID NO: 7215
  Description of Artificial Sequence: Synthetic oligonucleotide

SEQ ID NO: 7226 - protein, 12 aa, Artificial Sequence
  Description of Artificial Sequence: Synthetic peptide
RASQSVSSSYLA

SEQ ID NO: 7227 - DNA, 48 bp, Artificial Sequence; identical to SEQ ID NO: 7209
  Description of Artificial Sequence: Synthetic oligonucleotide

SEQ ID NO: 7228 - protein, 16 aa, Artificial Sequence
  Description of Artificial Sequence: Synthetic peptide
RSSQSLLYSNGYNYVD

SEQ ID NO: 7229 - DNA, 48 bp, Artificial Sequence; identical to SEQ ID NO: 7209
  Description of Artificial Sequence: Synthetic oligonucleotide

SEQ ID NO: 7230 - protein, 16 aa, Artificial Sequence
  Description of Artificial Sequence: Synthetic peptide
RSSQSLLYSNGYNYVD

SEQ ID NO: 7231 - DNA, 48 bp, Artificial Sequence
  Description of Artificial Sequence: Synthetic oligonucleotide
aggtctagtcagcgcctcctgtttagtaatggataccactatttggat

SEQ ID NO: 7232 - protein, 16 aa, Artificial Sequence
  Description of Artificial Sequence: Synthetic peptide
RSSQRLLFSNGYHYLD

SEQ ID NO: 7233 - DNA, 48 bp, Artificial Sequence; identical to SEQ ID NO: 7213
  Description of Artificial Sequence: Synthetic oligonucleotide

SEQ ID NO: 7234 - protein, 16 aa, Artificial Sequence
  Description of Artificial Sequence: Synthetic peptide
RSSQSLLYSNGYNYLD

SEQ ID NO: 7235 - DNA, 33 bp, Artificial Sequence
  Description of Artificial Sequence: Synthetic oligonucleotide
cgggcaagtcagagcattagcagctatttaaat

SEQ ID NO: 7236 - protein, 11 aa, Artificial Sequence
  Description of Artificial Sequence: Synthetic peptide
RASQSISSYLN

SEQ ID NO: 7237 - DNA, 48 bp, Artificial Sequence; identical to SEQ ID NO: 7211
  Description of Artificial Sequence: Synthetic oligonucleotide

SEQ ID NO: 7238 - protein, 16 aa, Artificial Sequence
  Description of Artificial Sequence: Synthetic peptide
RSSQSLLYSNGYHYLD

SEQ ID NO: 7239 - DNA, 48 bp, Artificial Sequence; identical to SEQ ID NO: 7213
  Description of Artificial Sequence: Synthetic oligonucleotide

SEQ ID NO: 7240 - protein, 16 aa, Artificial Sequence
  Description of Artificial Sequence: Synthetic peptide
RSSQSLLYSNGYNYLD

SEQ ID NO: 7241 - DNA, 48 bp, Artificial Sequence; identical to SEQ ID NO: 7213
  Description of Artificial Sequence: Synthetic oligonucleotide

SEQ ID NO: 7242 - protein, 16 aa, Artificial Sequence
  Description of Artificial Sequence: Synthetic peptide
RSSQSLLYSNGYNYLD

SEQ ID NO: 7243 - DNA, 48 bp, Artificial Sequence; identical to SEQ ID NO: 7213
  Description of Artificial Sequence: Synthetic oligonucleotide

SEQ ID NO: 7244 - protein, 16 aa, Artificial Sequence
  Description of Artificial Sequence: Synthetic peptide
RSSQSLLYSNGYNYLD

SEQ ID NO: 7245 - DNA, 48 bp, Artificial Sequence; identical to SEQ ID NO: 7209
  Description of Artificial Sequence: Synthetic oligonucleotide

SEQ ID NO: 7246 - protein, 16 aa, Artificial Sequence
  Description of Artificial Sequence: Synthetic peptide
RSSQSLLYSNGYNYVD

SEQ ID NO: 7247 - DNA, 48 bp, Artificial Sequence; identical to SEQ ID NO: 7213
  Description of Artificial Sequence: Synthetic oligonucleotide

SEQ ID NO: 7248 - protein, 16 aa, Artificial Sequence
  Description of Artificial Sequence: Synthetic peptide
RSSQSLLYSNGYNYLD

SEQ ID NO: 7249 - DNA, 48 bp, Artificial Sequence
  Description of Artificial Sequence: Synthetic oligonucleotide
aggtctagtcagagcctcctgtttagtaatggatacaactatttggat

SEQ ID NO: 7250 - protein, 16 aa, Artificial Sequence
  Description of Artificial Sequence: Synthetic peptide
RSSQSLLFSNGYNYLD

SEQ ID NO: 7251 - DNA, 33 bp, Artificial Sequence; identical to SEQ ID NO: 7235
  Description of Artificial Sequence: Synthetic oligonucleotide

SEQ ID NO: 7252 - protein, 11 aa, Artificial Sequence
  Description of Artificial Sequence: Synthetic peptide
RASQSISSYLN

SEQ ID NO: 7253 - DNA, 33 bp, Artificial Sequence
  Description of Artificial Sequence: Synthetic oligonucleotide
cgggcgagtcagggcattagcaattatttagcc

SEQ ID NO: 7254 - protein, 11 aa, Artificial Sequence
  Description of Artificial Sequence: Synthetic peptide
RASQGISNYLA

SEQ ID NO: 7255 - DNA, 48 bp, Artificial Sequence; identical to SEQ ID NO: 7213
  Description of Artificial Sequence: Synthetic oligonucleotide

SEQ ID NO: 7256 - protein, 16 aa, Artificial Sequence
  Description of Artificial Sequence: Synthetic peptide
RSSQSLLYSNGYNYLD

SEQ ID NO: 7257 - DNA, 48 bp, Artificial Sequence
  Description of Artificial Sequence: Synthetic oligonucleotide
aggtctagtcagagcctcctgcatagtaatggatacaactatttggat

SEQ ID NO: 7258 - protein, 16 aa, Artificial Sequence
  Description of Artificial Sequence: Synthetic peptide
RSSQSLLHSNGYNYLD

SEQ ID NO: 7259 - DNA, 48 bp, Artificial Sequence
  Description of Artificial Sequence: Synthetic oligonucleotide
aggtctagtcagagcctcctgtttagtaatggatactactatttggat

SEQ ID NO: 7260 - protein, 16 aa, Artificial Sequence
  Description of Artificial Sequence: Synthetic peptide
RSSQSLLFSNGYYYLD

SEQ ID NO: 7261 - DNA, 48 bp, Artificial Sequence; identical to SEQ ID NO: 7213
  Description of Artificial Sequence: Synthetic oligonucleotide

SEQ ID NO: 7262 - protein, 16 aa, Artificial Sequence
  Description of Artificial Sequence: Synthetic peptide
RSSQSLLYSNGYNYLD

SEQ ID NO: 7263 - DNA, 33 bp, Artificial Sequence; identical to SEQ ID NO: 7253
  Description of Artificial Sequence: Synthetic oligonucleotide

SEQ ID NO: 7264 - protein, 11 aa, Artificial Sequence
  Description of Artificial Sequence: Synthetic peptide
RASQGISNYLA

SEQ ID NO: 7265 - DNA, 48 bp, Artificial Sequence; identical to SEQ ID NO: 7213
  Description of Artificial Sequence: Synthetic oligonucleotide

SEQ ID NO: 7266 - protein, 16 aa, Artificial Sequence
  Description of Artificial Sequence: Synthetic peptide
RSSQSLLYSNGYNYLD

SEQ ID NO: 7267 - DNA, 48 bp, Artificial Sequence; identical to SEQ ID NO: 7213
  Description of Artificial Sequence: Synthetic oligonucleotide

SEQ ID NO: 7268 - protein, 16 aa, Artificial Sequence
  Description of Artificial Sequence: Synthetic peptide
RSSQSLLYSNGYNYLD

SEQ ID NO: 7269 - DNA, 48 bp, Artificial Sequence
  Description of Artificial Sequence: Synthetic oligonucleotide
aggtctagtcggagcctcctgcatagtaatggatacaactatttggat

SEQ ID NO: 7270 - protein, 16 aa, Artificial Sequence
  Description of Artificial Sequence: Synthetic peptide
RSSRSLLHSNGYNYLD

SEQ ID NO: 7271 - DNA, 48 bp, Artificial Sequence
  Description of Artificial Sequence: Synthetic oligonucleotide
aagtctagtcagagcctcctgtatagtaatggatacaactatttggat

SEQ ID NO: 7272 - protein, 16 aa, Artificial Sequence
  Description of Artificial Sequence: Synthetic peptide
KSSQSLLYSNGYNYLD

SEQ ID NO: 7273 - DNA, 42 bp, Artificial Sequence
  Description of Artificial Sequence: Synthetic oligonucleotide
actggaaccagcagtgacgttggtggttataactatgtctcc

SEQ ID NO: 7274 - protein, 14 aa, Artificial Sequence
  Description of Artificial Sequence: Synthetic peptide
TGTSSDVGGYNYVS

SEQ ID NO: 7275 - DNA, 51 bp, Artificial Sequence
  Description of Artificial Sequence: Synthetic oligonucleotide
aagtccagccagagtgttttatacagctccaacaataagaactacttagct

SEQ ID NO: 7276 - protein, 17 aa, Artificial Sequence
  Description of Artificial Sequence: Synthetic peptide
KSSQSVLYSSNNKNYLA

SEQ ID NO: 7277 - DNA, 51 bp, Artificial Sequence; identical to SEQ ID NO: 7275
  Description of Artificial Sequence: Synthetic oligonucleotide

SEQ ID NO: 7278 - protein, 17 aa, Artificial Sequence
  Description of Artificial Sequence: Synthetic peptide
KSSQSVLYSSNNKNYLA

SEQ ID NO: 7279 - DNA, 36 bp, Artificial Sequence; identical to SEQ ID NO: 7215
  Description of Artificial Sequence: Synthetic oligonucleotide

SEQ ID NO: 7280 - protein, 12 aa, Artificial Sequence
  Description of Artificial Sequence: Synthetic peptide
RASQSVSSSYLA

SEQ ID NO: 7281 - DNA, 39 bp, Artificial Sequence
  Description of Artificial Sequence: Synthetic oligonucleotide
tctggcagcagctccaacatcggaagtaattatgtatac

SEQ ID NO: 7282 - protein, 13 aa, Artificial Sequence
  Description of Artificial Sequence: Synthetic peptide
SGSSSNIGSNYVY

SEQ ID NO: 7283 - DNA, 33 bp, Artificial Sequence
  Description of Artificial Sequence: Synthetic oligonucleotide
caggcgagtcaggacattagcaactatttaaat

SEQ ID NO: 7284 - protein, 11 aa, Artificial Sequence
  Description of Artificial Sequence: Synthetic peptide
QASQDISNYLN

SEQ ID NO: 7285 - DNA, 39 bp, Artificial Sequence
  Description of Artificial Sequence: Synthetic oligonucleotide
actgggaacagcaacaatgttggcaaccaaggagcagct

SEQ ID NO: 7286 - protein, 13 aa, Artificial Sequence
  Description of Artificial Sequence: Synthetic peptide
TGNSNNVGNQGAA

SEQ ID NO: 7287 - DNA, 39 bp, Artificial Sequence; identical to SEQ ID NO: 7285
  Description of Artificial Sequence: Synthetic oligonucleotide

SEQ ID NO: 7288 - protein, 13 aa, Artificial Sequence
  Description of Artificial Sequence: Synthetic peptide
TGNSNNVGNQGAA

SEQ ID NO: 7289 - DNA, 51 bp, Artificial Sequence; identical to SEQ ID NO: 7275
  Description of Artificial Sequence: Synthetic oligonucleotide

SEQ ID NO: 7290 - protein, 17 aa, Artificial Sequence
  Description of Artificial Sequence: Synthetic peptide
KSSQSVLYSSNNKNYLA

SEQ ID NO: 7291 - DNA, 51 bp, Artificial Sequence; identical to SEQ ID NO: 7275
  Description of Artificial Sequence: Synthetic oligonucleotide

SEQ ID NO: 7292 - protein, 17 aa, Artificial Sequence
  Description of Artificial Sequence: Synthetic peptide
KSSQSVLYSSNNKNYLA

SEQ ID NO: 7293 - DNA, 48 bp, Artificial Sequence; identical to SEQ ID NO: 7257
  Description of Artificial Sequence: Synthetic oligonucleotide

SEQ ID NO: 7294 - protein, 16 aa, Artificial Sequence
  Description of Artificial Sequence: Synthetic peptide
RSSQSLLHSNGYNYLD

SEQ ID NO: 7295 - DNA, 36 bp, Artificial Sequence
  Description of Artificial Sequence: Synthetic oligonucleotide
agggccagtcagagtgttagcagcggctacttagcc

SEQ ID NO: 7296 - protein, 12 aa, Artificial Sequence
  Description of Artificial Sequence: Synthetic peptide
RASQSVSSGYLA

SEQ ID NO: 7297 - DNA, 51 bp, Artificial Sequence; identical to SEQ ID NO: 7275
  Description of Artificial Sequence: Synthetic oligonucleotide

SEQ ID NO: 7298 - protein, 17 aa, Artificial Sequence
  Description of Artificial Sequence: Synthetic peptide
KSSQSVLYSSNNKNYLA

SEQ ID NO: 7299 - DNA, 48 bp, Artificial Sequence
  Description of Artificial Sequence: Synthetic oligonucleotide
aggtctagtcagagcctcctgcatcgtaatggatacaactatttggat

SEQ ID NO: 7300 - protein, 16 aa, Artificial Sequence
  Description of Artificial Sequence: Synthetic peptide
RSSQSLLHRNGYNYLD

SEQ ID NO: 7301 - DNA, 51 bp, Artificial Sequence; identical to SEQ ID NO: 7275
  Description of Artificial Sequence: Synthetic oligonucleotide

SEQ ID NO: 7302 - protein, 17 aa, Artificial Sequence
  Description of Artificial Sequence: Synthetic peptide
KSSQSVLYSSNNKNYLA

SEQ ID NO: 7303 - DNA, 33 bp, Artificial Sequence; identical to SEQ ID NO: 7235
  Description of Artificial Sequence: Synthetic oligonucleotide

SEQ ID NO: 7304 - protein, 11 aa, Artificial Sequence
  Description of Artificial Sequence: Synthetic peptide
RASQSISSYLN

SEQ ID NO: 7305 - DNA, 33 bp, Artificial Sequence; identical to SEQ ID NO: 7235
  Description of Artificial Sequence: Synthetic oligonucleotide

SEQ ID NO: 7306 - protein, 11 aa, Artificial Sequence
  Description of Artificial Sequence: Synthetic peptide
RASQSISSYLN

SEQ ID NO: 7307 - DNA, 42 bp, Artificial Sequence; identical to SEQ ID NO: 7273
  Description of Artificial Sequence: Synthetic oligonucleotide

SEQ ID NO: 7308 - protein, 14 aa, Artificial Sequence
  Description of Artificial Sequence: Synthetic peptide
TGTSSDVGGYNYVS

SEQ ID NO: 7309 - DNA, 36 bp, Artificial Sequence; identical to SEQ ID NO: 7215
  Description of Artificial Sequence: Synthetic oligonucleotide

SEQ ID NO: 7310 - protein, 12 aa, Artificial Sequence
  Description of Artificial Sequence: Synthetic peptide
RASQSVSSSYLA

SEQ ID NO: 7311 - DNA, 51 bp, Artificial Sequence; identical to SEQ ID NO: 7275
  Description of Artificial Sequence: Synthetic oligonucleotide

SEQ ID NO: 7312 - protein, 17 aa, Artificial Sequence
  Description of Artificial Sequence: Synthetic peptide
KSSQSVLYSSNNKNYLA

SEQ ID NO: 7313 - DNA, 36 bp, Artificial Sequence; identical to SEQ ID NO: 7215
  Description of Artificial Sequence: Synthetic oligonucleotide

SEQ ID NO: 7314 - protein, 12 aa, Artificial Sequence
  Description of Artificial Sequence: Synthetic peptide
RASQSVSSSYLA

SEQ ID NO: 7315 - DNA, 48 bp, Artificial Sequence; identical to SEQ ID NO: 7213
  Description of Artificial Sequence: Synthetic oligonucleotide

SEQ ID NO: 7316 - protein, 16 aa, Artificial Sequence
  Description of Artificial Sequence: Synthetic peptide
RSSQSLLYSNGYNYLD

SEQ ID NO: 7317 - DNA, 51 bp, Artificial Sequence; identical to SEQ ID NO: 7275
  Description of Artificial Sequence: Synthetic oligonucleotide

SEQ ID NO: 7318 - protein, 17 aa, Artificial Sequence
  Description of Artificial Sequence: Synthetic peptide
KSSQSVLYSSNNKNYLA

SEQ ID NO: 7319 - DNA, 33 bp, Artificial Sequence; identical to SEQ ID NO: 7235
  Description of Artificial Sequence: Synthetic oligonucleotide

SEQ ID NO: 7320 - protein, 11 aa, Artificial Sequence
  Description of Artificial Sequence: Synthetic peptide
RASQSISSYLN

SEQ ID NO: 7321 - DNA, 33 bp, Artificial Sequence; identical to SEQ ID NO: 7235
  Description of Artificial Sequence: Synthetic oligonucleotide

SEQ ID NO: 7322 - protein, 11 aa, Artificial Sequence
  Description of Artificial Sequence: Synthetic peptide
RASQSISSYLN

SEQ ID NO: 7323 - DNA, 33 bp, Artificial Sequence; identical to SEQ ID NO: 7283
  Description of Artificial Sequence: Synthetic oligonucleotide

SEQ ID NO: 7324 - protein, 11 aa, Artificial Sequence
  Description of Artificial Sequence: Synthetic peptide
QASQDISNYLN

SEQ ID NO: 7325 - DNA, 33 bp, Artificial Sequence
  Description of Artificial Sequence: Synthetic oligonucleotide
cgggcgagtcagggcattagcaattatttggca

SEQ ID NO: 7326 - protein, 11 aa, Artificial Sequence
  Description of Artificial Sequence: Synthetic peptide
RASQGISNYLA

SEQ ID NO: 7327 - DNA, 33 bp, Artificial Sequence; identical to SEQ ID NO: 7235
  Description of Artificial Sequence: Synthetic oligonucleotide

SEQ ID NO: 7328 - protein, 11 aa, Artificial Sequence
  Description of Artificial Sequence: Synthetic peptide
RASQSISSYLN

SEQ ID NO: 7329 - DNA, 39 bp, Artificial Sequence; identical to SEQ ID NO: 7285
  Description of Artificial Sequence: Synthetic oligonucleotide

SEQ ID NO: 7330 - protein, 13 aa, Artificial Sequence
  Description of Artificial Sequence: Synthetic peptide
TGNSNNVGNQGAA

SEQ ID NO: 7331 - DNA, 33 bp, Artificial Sequence; identical to SEQ ID NO: 7283
  Description of Artificial Sequence: Synthetic oligonucleotide

SEQ ID NO: 7332 - protein, 11 aa, Artificial Sequence
  Description of Artificial Sequence: Synthetic peptide
QASQDISNYLN

SEQ ID NO: 7333 - DNA, 33 bp, Artificial Sequence; identical to SEQ ID NO: 7235
  Description of Artificial Sequence: Synthetic oligonucleotide

SEQ ID NO: 7334 - protein, 11 aa, Artificial Sequence
  Description of Artificial Sequence: Synthetic peptide
RASQSISSYLN

SEQ ID NO: 7335 - DNA, 48 bp, Artificial Sequence
  Description of Artificial Sequence: Synthetic oligonucleotide
aggtctagtcagagcctcctgcacagaaatggatacaactatttggat

SEQ ID NO: 7336 - protein, 16 aa, Artificial Sequence
  Description of Artificial Sequence: Synthetic peptide
RSSQSLLHRNGYNYLD

SEQ ID NO: 7337 - DNA, 48 bp, Artificial Sequence; identical to SEQ ID NO: 7257
  Description of Artificial Sequence: Synthetic oligonucleotide

SEQ ID NO: 7338 - protein, 16 aa, Artificial Sequence
  Description of Artificial Sequence: Synthetic peptide
RSSQSLLHSNGYNYLD

SEQ ID NO: 7339 - DNA, 48 bp, Artificial Sequence
  Description of Artificial Sequence: Synthetic oligonucleotide
aggtctagtcagagcctcctgcatagtaatggatacaactatgtggat

SEQ ID NO: 7340 - protein, 16 aa, Artificial Sequence
  Description of Artificial Sequence: Synthetic peptide
RSSQSLLHSNGYNYVD

SEQ ID NO: 7341 - DNA, 48 bp, Artificial Sequence
  Description of Artificial Sequence: Synthetic oligonucleotide
aggtctagtcagagcctcctgcatagaaatggatacaattatttggat

SEQ ID NO: 7342 - protein, 16 aa, Artificial Sequence
  Description of Artificial Sequence: Synthetic peptide
RSSQSLLHRNGYNYLD

SEQ ID NO: 7343 - DNA, 33 bp, Artificial Sequence
  Description of Artificial Sequence: Synthetic oligonucleotide
caggcgaggcaggacattagcgactatttaaat

SEQ ID NO: 7344 - protein, 11 aa, Artificial Sequence
  Description of Artificial Sequence: Synthetic peptide
QARQDISDYLN

SEQ ID NO: 7345 - DNA, 33 bp, Artificial Sequence
  Description of Artificial Sequence: Synthetic oligonucleotide
cggacaagtcagagcattaacagctatttaaat

SEQ ID NO: 7346 - protein, 11 aa, Artificial Sequence
  Description of Artificial Sequence: Synthetic peptide
RTSQSINSYLN

SEQ ID NO: 7347 - DNA, 48 bp, Artificial Sequence
  Description of Artificial Sequence: Synthetic oligonucleotide
aggtctagtcagagcctcctgcatagtactggatacaactatttggat

SEQ ID NO: 7348 - protein, 16 aa, Artificial Sequence
  Description of Artificial Sequence: Synthetic peptide
RSSQSLLHSTGYNYLD

SEQ ID NO: 7349 - DNA, 48 bp, Artificial Sequence; identical to SEQ ID NO: 7341
  Description of Artificial Sequence: Synthetic oligonucleotide

SEQ ID NO: 7350 - protein, 16 aa, Artificial Sequence
  Description of Artificial Sequence: Synthetic peptide
RSSQSLLHRNGYNYLD

SEQ ID NO: 7351 - DNA, 48 bp, Artificial Sequence
  Description of Artificial Sequence: Synthetic oligonucleotide
aggtctagtcagagcctcctgcatcgtaatggataccactatttggat

SEQ ID NO: 7352 - protein, 16 aa, Artificial Sequence
  Description of Artificial Sequence: Synthetic peptide
RSSQSLLHRNGYHYLD

SEQ ID NO: 7353 - DNA, 48 bp, Artificial Sequence
  Description of Artificial Sequence: Synthetic oligonucleotide
aggtctagtcagagcctcctgcatagaaatggatacaactatttggat

SEQ ID NO: 7354 - protein, 16 aa, Artificial Sequence
  Description of Artificial Sequence: Synthetic peptide
RSSQSLLHRNGYNYLD

SEQ ID NO: 7355 - DNA, 33 bp, Artificial Sequence
  Description of Artificial Sequence: Synthetic oligonucleotide
cggacaagtcagagcattagcagctatttaaat

SEQ ID NO: 7356 - protein, 11 aa, Artificial Sequence
  Description of Artificial Sequence: Synthetic peptide
RTSQSISSYLN

SEQ ID NO: 7357 - DNA, 33 bp, Artificial Sequence; identical to SEQ ID NO: 7345
  Description of Artificial Sequence: Synthetic oligonucleotide

SEQ ID NO: 7358 - protein, 11 aa, Artificial Sequence
  Description of Artificial Sequence: Synthetic peptide
RTSQSINSYLN

SEQ ID NO: 7359 - DNA, 33 bp, Artificial Sequence; identical to SEQ ID NO: 7355
  Description of Artificial Sequence: Synthetic oligonucleotide

SEQ ID NO: 7360 - protein, 11 aa, Artificial Sequence
  Description of Artificial Sequence: Synthetic peptide
RTSQSISSYLN

SEQ ID NO: 7361 - DNA, 48 bp, Artificial Sequence; identical to SEQ ID NO: 7299
  Description of Artificial Sequence: Synthetic oligonucleotide

SEQ ID NO: 7362 - protein, 16 aa, Artificial Sequence
  Description of Artificial Sequence: Synthetic peptide
RSSQSLLHRNGYNYLD

SEQ ID NO: 7363 - DNA, 48 bp, Artificial Sequence; identical to SEQ ID NO: 7351
  Description of Artificial Sequence: Synthetic oligonucleotide

SEQ ID NO: 7364 - protein, 16 aa, Artificial Sequence
  Description of Artificial Sequence: Synthetic peptide
RSSQSLLHRNGYHYLD

SEQ ID NO: 7365 - DNA, 48 bp, Artificial Sequence; identical to SEQ ID NO: 7257
  Description of Artificial Sequence: Synthetic oligonucleotide

SEQ ID NO: 7366 - protein, 16 aa, Artificial Sequence
  Description of Artificial Sequence: Synthetic peptide
RSSQSLLHSNGYNYLD

SEQ ID NO: 7367 - DNA, 48 bp, Artificial Sequence; identical to SEQ ID NO: 7257
  Description of Artificial Sequence: Synthetic oligonucleotide

SEQ ID NO: 7368 - protein, 16 aa, Artificial Sequence
  Description of Artificial Sequence: Synthetic peptide
RSSQSLLHSNGYNYLD

SEQ ID NO: 7369 - DNA, 48 bp, Artificial Sequence; identical to SEQ ID NO: 7341
  Description of Artificial Sequence: Synthetic oligonucleotide

SEQ ID NO: 7370 - protein, 16 aa, Artificial Sequence
  Description of Artificial Sequence: Synthetic peptide
RSSQSLLHRNGYNYLD

SEQ ID NO: 7371 - DNA, 48 bp, Artificial Sequence
  Description of Artificial Sequence: Synthetic oligonucleotide
aggtctagtcagagcctcctgcatagaaatggttacaattatttggat

SEQ ID NO: 7372 - protein, 16 aa, Artificial Sequence
  Description of Artificial Sequence: Synthetic peptide
RSSQSLLHRNGYNYLD

SEQ ID NO: 7373 - DNA, 48 bp, Artificial Sequence; identical to SEQ ID NO: 7353
  Description of Artificial Sequence: Synthetic oligonucleotide

SEQ ID NO: 7374 - protein, 16 aa, Artificial Sequence
  Description of Artificial Sequence: Synthetic peptide
RSSQSLLHRNGYNYLD

SEQ ID NO: 7375 - DNA, 48 bp, Artificial Sequence; identical to SEQ ID NO: 7351
  Description of Artificial Sequence: Synthetic oligonucleotide

SEQ ID NO: 7376 - protein, 16 aa, Artificial Sequence
  Description of Artificial Sequence: Synthetic peptide
RSSQSLLHRNGYHYLD

SEQ ID NO: 7377 - DNA, 48 bp, Artificial Sequence; identical to SEQ ID NO: 7353
  Description of Artificial Sequence: Synthetic oligonucleotide

SEQ ID NO: 7378 - protein, 16 aa, Artificial Sequence
  Description of Artificial Sequence: Synthetic peptide
RSSQSLLHRNGYNYLD

SEQ ID NO: 7379 - DNA, 48 bp, Artificial Sequence; identical to SEQ ID NO: 7347
  Description of Artificial Sequence: Synthetic oligonucleotide

SEQ ID NO: 7380 - protein, 16 aa, Artificial Sequence
  Description of Artificial Sequence: Synthetic peptide
RSSQSLLHSTGYNYLD

SEQ ID NO: 7381 - DNA, 33 bp, Artificial Sequence; identical to SEQ ID NO: 7355
  Description of Artificial Sequence: Synthetic oligonucleotide

SEQ ID NO: 7382 - protein, 11 aa, Artificial Sequence
  Description of Artificial Sequence: Synthetic peptide
RTSQSISSYLN

SEQ ID NO: 7383 - DNA, 48 bp, Artificial Sequence; identical to SEQ ID NO: 7257
  Description of Artificial Sequence: Synthetic oligonucleotide

SEQ ID NO: 7384 - protein, 16 aa, Artificial Sequence
  Description of Artificial Sequence: Synthetic peptide
RSSQSLLHSNGYNYLD

SEQ ID NO: 7385 - DNA, 33 bp, Artificial Sequence
  Description of Artificial Sequence: Synthetic oligonucleotide
gggggaaacaacattggaagtaaaagtgtgcac

SEQ ID NO: 7386 - protein, 11 aa, Artificial Sequence
  Description of Artificial Sequence: Synthetic peptide
GGNNIGSKSVH

SEQ ID NO: 7387 - DNA, 33 bp, Artificial Sequence
  Description of Artificial Sequence: Synthetic oligonucleotide
gggggaaacaacattggaagtaaaagtgtgcag

SEQ ID NO: 7388 - protein, 11 aa, Artificial Sequence
  Description of Artificial Sequence: Synthetic peptide
GGNNIGSKSVQ

SEQ ID NO: 7389 - DNA, 33 bp, Artificial Sequence; identical to SEQ ID NO: 7385
  Description of Artificial Sequence: Synthetic oligonucleotide

SEQ ID NO: 7390 - protein, 11 aa, Artificial Sequence
  Description of Artificial Sequence: Synthetic peptide
GGNNIGSKSVH

SEQ ID NO: 7391 - DNA, 33 bp, Artificial Sequence; identical to SEQ ID NO: 7385
  Description of Artificial Sequence: Synthetic oligonucleotide

SEQ ID NO: 7392 - protein, 11 aa, Artificial Sequence
  Description of Artificial Sequence: Synthetic peptide
GGNNIGSKSVH

SEQ ID NO: 7393 - DNA, 33 bp, Artificial Sequence; identical to SEQ ID NO: 7385
  Description of Artificial Sequence: Synthetic oligonucleotide

SEQ ID NO: 7394 - protein, 11 aa, Artificial Sequence
  Description of Artificial Sequence: Synthetic peptide
GGNNIGSKSVH

SEQ ID NO: 7395 - DNA, 33 bp, Artificial Sequence; identical to SEQ ID NO: 7385
  Description of Artificial Sequence: Synthetic oligonucleotide

SEQ ID NO: 7396 - protein, 11 aa, Artificial Sequence
  Description of Artificial Sequence: Synthetic peptide
GGNNIGSKSVH

SEQ ID NO: 7397 - DNA, 33 bp, Artificial Sequence; identical to SEQ ID NO: 7385
  Description of Artificial Sequence: Synthetic oligonucleotide

SEQ ID NO: 7398 - protein, 11 aa, Artificial Sequence
  Description of Artificial Sequence: Synthetic peptide
GGNNIGSKSVH

SEQ ID NO: 7399 - DNA, 33 bp, Artificial Sequence; identical to SEQ ID NO: 7385
  Description of Artificial Sequence: Synthetic oligonucleotide

SEQ ID NO: 7400 - protein, 11 aa, Artificial Sequence
  Description of Artificial Sequence: Synthetic peptide
GGNNIGSKSVH

SEQ ID NO: 7401 - DNA, 33 bp, Artificial Sequence; identical to SEQ ID NO: 7385
  Description of Artificial Sequence: Synthetic oligonucleotide

SEQ ID NO: 7402 - protein, 11 aa, Artificial Sequence
  Description of Artificial Sequence: Synthetic peptide
GGNNIGSKSVH

SEQ ID NO: 7403 - DNA, 33 bp, Artificial Sequence; identical to SEQ ID NO: 7387
  Description of Artificial Sequence: Synthetic oligonucleotide

SEQ ID NO: 7404 - protein, 11 aa, Artificial Sequence
  Description of Artificial Sequence: Synthetic peptide
GGNNIGSKSVQ

SEQ ID NO: 7405 - DNA, 33 bp, Artificial Sequence; identical to SEQ ID NO: 7385
  Description of Artificial Sequence: Synthetic oligonucleotide

SEQ ID NO: 7406 - protein, 11 aa, Artificial Sequence
  Description of Artificial Sequence: Synthetic peptide
GGNNIGSKSVH

SEQ ID NO: 7407 - DNA, 33 bp, Artificial Sequence; identical to SEQ ID NO: 7387
  Description of Artificial Sequence: Synthetic oligonucleotide

SEQ ID NO: 7408 - protein, 11 aa, Artificial Sequence
  Description of Artificial Sequence: Synthetic peptide
GGNNIGSKSVQ

SEQ ID NO: 7409 - DNA, 33 bp, Artificial Sequence; identical to SEQ ID NO: 7385
  Description of Artificial Sequence: Synthetic oligonucleotide

SEQ ID NO: 7410 - protein, 11 aa, Artificial Sequence
  Description of Artificial Sequence: Synthetic peptide
GGNNIGSKSVH

SEQ ID NO: 7411 - DNA, 33 bp, Artificial Sequence; identical to SEQ ID NO: 7385
  Description of Artificial Sequence: Synthetic oligonucleotide

SEQ ID NO: 7412 - protein, 11 aa, Artificial Sequence
  Description of Artificial Sequence: Synthetic peptide
GGNNIGSKSVH

SEQ ID NO: 7413 - DNA, 33 bp, Artificial Sequence
  Description of Artificial Sequence: Synthetic oligonucleotide
gggggaaacaacattggaattaaaagtgtgcac

SEQ ID NO: 7414 - protein, 11 aa, Artificial Sequence
  Description of Artificial Sequence: Synthetic peptide
GGNNIGIKSVH

SEQ ID NO: 7415 - DNA, 33 bp, Artificial Sequence; identical to SEQ ID NO: 7385
  Description of Artificial Sequence: Synthetic oligonucleotide

SEQ ID NO: 7416 - protein, 11 aa, Artificial Sequence
  Description of Artificial Sequence: Synthetic peptide
GGNNIGSKSVH

SEQ ID NO: 7417 - DNA, 33 bp, Artificial Sequence; identical to SEQ ID NO: 7385
  Description of Artificial Sequence: Synthetic oligonucleotide

SEQ ID NO: 7418 - protein, 11 aa, Artificial Sequence
  Description of Artificial Sequence: Synthetic peptide
GGNNIGSKSVH

SEQ ID NO: 7419 - DNA, 33 bp, Artificial Sequence; identical to SEQ ID NO: 7385
  Description of Artificial Sequence: Synthetic oligonucleotide

SEQ ID NO: 7420 - protein, 11 aa, Artificial Sequence
  Description of Artificial Sequence: Synthetic peptide
GGNNIGSKSVH

SEQ ID NO: 7421 - DNA, 33 bp, Artificial Sequence; identical to SEQ ID NO: 7387
  Description of Artificial Sequence: Synthetic oligonucleotide

SEQ ID NO: 7422 - protein, 11 aa, Artificial Sequence
  Description of Artificial Sequence: Synthetic peptide
GGNNIGSKSVQ

SEQ ID NO: 7423 - DNA, 33 bp, Artificial Sequence; identical to SEQ ID NO: 7385
  Description of Artificial Sequence: Synthetic oligonucleotide

SEQ ID NO: 7424 - protein, 11 aa, Artificial Sequence
  Description of Artificial Sequence: Synthetic peptide
GGNNIGSKSVH

SEQ ID NO: 7425 - DNA, 33 bp, Artificial Sequence; identical to SEQ ID NO: 7385
  Description of Artificial Sequence: Synthetic oligonucleotide

SEQ ID NO: 7426 - protein, 11 aa, Artificial Sequence
  Description of Artificial Sequence: Synthetic peptide
GGNNIGSKSVH

SEQ ID NO: 7427 - DNA, 33 bp, Artificial Sequence; identical to SEQ ID NO: 7385
  Description of Artificial Sequence: Synthetic oligonucleotide

SEQ ID NO: 7428 - protein, 11 aa, Artificial Sequence
  Description of Artificial Sequence: Synthetic peptide
GGNNIGSKSVH

SEQ ID NO: 7429 - DNA, 33 bp, Artificial Sequence; identical to SEQ ID NO: 7387
  Description of Artificial Sequence: Synthetic oligonucleotide

SEQ ID NO: 7430 - protein, 11 aa, Artificial Sequence
  Description of Artificial Sequence: Synthetic peptide
GGNNIGSKSVQ

SEQ ID NO: 7431 - DNA, 33 bp, Artificial Sequence; identical to SEQ ID NO: 7385
  Description of Artificial Sequence: Synthetic oligonucleotide

SEQ ID NO: 7432 - protein, 11 aa, Artificial Sequence
  Description of Artificial Sequence: Synthetic peptide
GGNNIGSKSVH

SEQ ID NO: 7433 - DNA, 33 bp, Artificial Sequence; identical to SEQ ID NO: 7385
  Description of Artificial Sequence: Synthetic oligonucleotide

SEQ ID NO: 7434 - protein, 11 aa, Artificial Sequence
  Description of Artificial Sequence: Synthetic peptide
GGNNIGSKSVH

SEQ ID NO: 7435 - DNA, 33 bp, Artificial Sequence; identical to SEQ ID NO: 7385
  Description of Artificial Sequence: Synthetic oligonucleotide

SEQ ID NO: 7436 - protein, 11 aa, Artificial Sequence
  Description of Artificial Sequence: Synthetic peptide
GGNNIGSKSVH

SEQ ID NO: 7437 - DNA, 33 bp, Artificial Sequence; identical to SEQ ID NO: 7385
  Description of Artificial Sequence: Synthetic oligonucleotide

SEQ ID NO: 7438 - protein, 11 aa, Artificial Sequence
  Description of Artificial Sequence: Synthetic peptide
GGNNIGSKSVH

SEQ ID NO: 7439 - DNA, 33 bp, Artificial Sequence; identical to SEQ ID NO: 7385
  Description of Artificial Sequence: Synthetic oligonucleotide

SEQ ID NO: 7440 - protein, 11 aa, Artificial Sequence
  Description of Artificial Sequence: Synthetic peptide
GGNNIGSKSVH

SEQ ID NO: 7441 - DNA, 33 bp, Artificial Sequence; identical to SEQ ID NO: 7385
  Description of Artificial Sequence: Synthetic oligonucleotide

SEQ ID NO: 7442 - protein, 11 aa, Artificial Sequence
  Description of Artificial Sequence: Synthetic peptide
GGNNIGSKSVH

SEQ ID NO: 7443 - DNA, 33 bp, Artificial Sequence; identical to SEQ ID NO: 7385
  Description of Artificial Sequence: Synthetic oligonucleotide

SEQ ID NO: 7444 - protein, 11 aa, Artificial Sequence
  Description of Artificial Sequence: Synthetic peptide
GGNNIGSKSVH

SEQ ID NO: 7445 - DNA, 33 bp, Artificial Sequence; identical to SEQ ID NO: 7385
  Description of Artificial Sequence: Synthetic oligonucleotide

SEQ ID NO: 7446 - protein, 11 aa, Artificial Sequence
  Description of Artificial Sequence: Synthetic peptide
GGNNIGSKSVH

SEQ ID NO: 7447 - DNA, 33 bp, Artificial Sequence
  Description of Artificial Sequence: Synthetic oligonucleotide
gggggaaacaacattggaagtaaaggtgtgcag

SEQ ID NO: 7448 - protein, 11 aa, Artificial Sequence
  Description of Artificial Sequence: Synthetic peptide
GGNNIGSKGVQ

SEQ ID NO: 7449 - DNA, 33 bp, Artificial Sequence; identical to SEQ ID NO: 7387
  Description of Artificial Sequence: Synthetic oligonucleotide

SEQ ID NO: 7450 - protein, 11 aa, Artificial Sequence
  Description of Artificial Sequence: Synthetic peptide
GGNNIGSKSVQ

SEQ ID NO: 7451 - DNA, 33 bp, Artificial Sequence; identical to SEQ ID NO: 7385
  Description of Artificial Sequence: Synthetic oligonucleotide

SEQ ID NO: 7452 - protein, 11 aa, Artificial Sequence
  Description of Artificial Sequence: Synthetic peptide
GGNNIGSKSVH

SEQ ID NO: 7453 - DNA, 33 bp, Artificial Sequence; identical to SEQ ID NO: 7253
  Description of Artificial Sequence: Synthetic oligonucleotide

SEQ ID NO: 7454 - protein, 11 aa, Artificial Sequence
  Description of Artificial Sequence: Synthetic peptide
RASQGISNYLA

SEQ ID NO: 7455 - DNA, 33 bp, Artificial Sequence; identical to SEQ ID NO: 7253
  Description of Artificial Sequence: Synthetic oligonucleotide

SEQ ID NO: 7456 - protein, 11 aa, Artificial Sequence
  Description of Artificial Sequence: Synthetic peptide
RASQGISNYLA

SEQ ID NO: 7457 - DNA, 33 bp, Artificial Sequence; identical to SEQ ID NO: 7253
  Description of Artificial Sequence: Synthetic oligonucleotide

SEQ ID NO: 7458 - protein, 11 aa, Artificial Sequence
  Description of Artificial Sequence: Synthetic peptide
RASQGISNYLA

SEQ ID NO: 7459 - DNA, 33 bp, Artificial Sequence; identical to SEQ ID NO: 7385
  Description of Artificial Sequence: Synthetic oligonucleotide

SEQ ID NO: 7460 - protein, 11 aa, Artificial Sequence
  Description of Artificial Sequence: Synthetic peptide
GGNNIGSKSVH

SEQ ID NO: 7461 - DNA, 33 bp, Artificial Sequence; identical to SEQ ID NO: 7385
  Description of Artificial Sequence: Synthetic oligonucleotide

SEQ ID NO: 7462 - protein, 11 aa, Artificial Sequence
  Description of Artificial Sequence: Synthetic peptide
GGNNIGSKSVH

SEQ ID NO: 7463 - DNA, 33 bp, Artificial Sequence; identical to SEQ ID NO: 7385
  Description of Artificial Sequence: Synthetic oligonucleotide

SEQ ID NO: 7464 - protein, 11 aa, Artificial Sequence
  Description of Artificial Sequence: Synthetic peptide
GGNNIGSKSVH

SEQ ID NO: 7465 - DNA, 33 bp, Artificial Sequence; identical to SEQ ID NO: 7385
  Description of Artificial Sequence: Synthetic oligonucleotide

SEQ ID NO: 7466 - protein, 11 aa, Artificial Sequence
  Description of Artificial Sequence: Synthetic peptide
GGNNIGSKSVH

SEQ ID NO: 7467 - DNA, 33 bp, Artificial Sequence
  Description of Artificial Sequence: Synthetic oligonucleotide
gggggaaataacattggaagtaaaagtgtgcac

SEQ ID NO: 7468 - protein, 11 aa, Artificial Sequence
  Description of Artificial Sequence: Synthetic peptide
GGNNIGSKSVH

SEQ ID NO: 7469 - DNA, 33 bp, Artificial Sequence; identical to SEQ ID NO: 7385
  Description of Artificial Sequence: Synthetic oligonucleotide

SEQ ID NO: 7470 - protein, 11 aa, Artificial Sequence
  Description of Artificial Sequence: Synthetic peptide
GGNNIGSKSVH

SEQ ID NO: 7471 - DNA, 33 bp, Artificial Sequence; identical to SEQ ID NO: 7385
  Description of Artificial Sequence: Synthetic oligonucleotide

SEQ ID NO: 7472 - protein, 11 aa, Artificial Sequence
  Description of Artificial Sequence: Synthetic peptide
GGNNIGSKSVH

SEQ ID NO: 7473 - DNA, 33 bp, Artificial Sequence; identical to SEQ ID NO: 7385
  Description of Artificial Sequence: Synthetic oligonucleotide

SEQ ID NO: 7474 - protein, 11 aa, Artificial Sequence
  Description of Artificial Sequence: Synthetic peptide
GGNNIGSKSVH

SEQ ID NO: 7475 - DNA, 33 bp, Artificial Sequence; identical to SEQ ID NO: 7385
  Description of Artificial Sequence: Synthetic oligonucleotide

SEQ ID NO: 7476 - protein, 11 aa, Artificial Sequence
  Description of Artificial Sequence: Synthetic peptide
GGNNIGSKSVH

SEQ ID NO: 7477 - DNA, 33 bp, Artificial Sequence; identical to SEQ ID NO: 7385
  Description of Artificial Sequence: Synthetic oligonucleotide

SEQ ID NO: 7478 - protein, 11 aa, Artificial Sequence
  Description of Artificial Sequence: Synthetic peptide
GGNNIGSKSVH

SEQ ID NO: 7479 - DNA, 33 bp, Artificial Sequence; identical to SEQ ID NO: 7385
  Description of Artificial Sequence: Synthetic oligonucleotide

SEQ ID NO: 7480 - protein, 11 aa, Artificial Sequence
  Description of Artificial Sequence: Synthetic peptide
GGNNIGSKSVH

SEQ ID NO: 7481 - DNA, 33 bp, Artificial Sequence; identical to SEQ ID NO: 7385
  Description of Artificial Sequence: Synthetic oligonucleotide

SEQ ID NO: 7482 - protein, 11 aa, Artificial Sequence
  Description of Artificial Sequence: Synthetic peptide
GGNNIGSKSVH

SEQ ID NO: 7483 - DNA, 33 bp, Artificial Sequence; identical to SEQ ID NO: 7385
  Description of Artificial Sequence: Synthetic oligonucleotide

SEQ ID NO: 7484 - protein, 11 aa, Artificial Sequence
  Description of Artificial Sequence: Synthetic peptide
GGNNIGSKSVH

SEQ ID NO: 7485 - DNA, 51 bp, Artificial Sequence; identical to SEQ ID NO: 7275
  Description of Artificial Sequence: Synthetic oligonucleotide

SEQ ID NO: 7486 - protein, 17 aa, Artificial Sequence
  Description of Artificial Sequence: Synthetic peptide
KSSQSVLYSSNNKNYLA

SEQ ID NO: 7487 - DNA, 51 bp, Artificial Sequence
  Description of Artificial Sequence: Synthetic oligonucleotide
aagtccagccagagtgttttatacagctccaacaataaaaactacttagct

SEQ ID NO: 7488 - protein, 17 aa, Artificial Sequence
  Description of Artificial Sequence: Synthetic peptide
KSSQSVLYSSNNKNYLA

SEQ ID NO: 7489 - DNA, 33 bp, Artificial Sequence
  Description of Artificial Sequence: Synthetic oligonucleotide
cgggcaagtcagagcattagcaactatttcaat

SEQ ID NO: 7490 - protein, 11 aa, Artificial Sequence
  Description of Artificial Sequence: Synthetic peptide
RASQSISNYFN

SEQ ID NO: 7491 - DNA, 33 bp, Artificial Sequence
  Description of Artificial Sequence: Synthetic oligonucleotide
cgggcaagtcagtttattagcagctatttaaat

SEQ ID NO: 7492 - protein, 11 aa, Artificial Sequence
  Description of Artificial Sequence: Synthetic peptide
RASQFISSYLN

SEQ ID NO: 7493 - DNA, 33 bp, Artificial Sequence; identical to SEQ ID NO: 7235
  Description of Artificial Sequence: Synthetic oligonucleotide

SEQ ID NO: 7494 - protein, 11 aa, Artificial Sequence
  Description of Artificial Sequence: Synthetic peptide
RASQSISSYLN

SEQ ID NO: 7495 - DNA, 33 bp, Artificial Sequence; identical to SEQ ID NO: 7235
  Description of Artificial Sequence: Synthetic oligonucleotide

SEQ ID NO: 7496 - protein, 11 aa, Artificial Sequence
  Description of Artificial Sequence: Synthetic peptide
RASQSISSYLN

SEQ ID NO: 7497 - DNA, 33 bp, Artificial Sequence; identical to SEQ ID NO: 7283
  Description of Artificial Sequence: Synthetic oligonucleotide

SEQ ID NO: 7498 - protein, 11 aa, Artificial Sequence
  Description of Artificial Sequence: Synthetic peptide
QASQDISNYLN

SEQ ID NO: 7499 - DNA, 33 bp, Artificial Sequence; identical to SEQ ID NO: 7235
  Description of Artificial Sequence: Synthetic oligonucleotide

SEQ ID NO: 7500 - protein, 11 aa, Artificial Sequence
  Description of Artificial Sequence: Synthetic peptide
RASQSISSYLN

SEQ ID NO: 7501 - DNA, 33 bp, Artificial Sequence; identical to SEQ ID NO: 7283
  Description of Artificial Sequence: Synthetic oligonucleotide

SEQ ID NO: 7502 - protein, 11 aa, Artificial Sequence
  Description of Artificial Sequence: Synthetic peptide
QASQDISNYLN

SEQ ID NO: 7503 - DNA, 33 bp, Artificial Sequence; identical to SEQ ID NO: 7355
  Description of Artificial Sequence: Synthetic oligonucleotide

SEQ ID NO: 7504 - protein, 11 aa, Artificial Sequence
  Description of Artificial Sequence: Synthetic peptide
RTSQSISSYLN

SEQ ID NO: 7505 - DNA, 33 bp, Artificial Sequence; identical to SEQ ID NO: 7355
  Description of Artificial Sequence: Synthetic oligonucleotide

SEQ ID NO: 7506 - protein, 11 aa, Artificial Sequence
  Description of Artificial Sequence: Synthetic peptide
RTSQSISSYLN

SEQ ID NO: 7507 - DNA, 33 bp, Artificial Sequence; identical to SEQ ID NO: 7355
  Description of Artificial Sequence: Synthetic oligonucleotide

SEQ ID NO: 7508 - protein, 11 aa, Artificial Sequence
  Description of Artificial Sequence: Synthetic peptide
RTSQSISSYLN

SEQ ID NO: 7509 - DNA, 33 bp, Artificial Sequence; identical to SEQ ID NO: 7355
  Description of Artificial Sequence: Synthetic oligonucleotide

SEQ ID NO: 7510 - protein, 11 aa, Artificial Sequence
  Description of Artificial Sequence: Synthetic peptide
RTSQSISSYLN

SEQ ID NO: 7511 - DNA, 33 bp, Artificial Sequence; identical to SEQ ID NO: 7355
  Description of Artificial Sequence: Synthetic oligonucleotide

SEQ ID NO: 7512 - protein, 11 aa, Artificial Sequence
  Description of Artificial Sequence: Synthetic peptide
RTSQSISSYLN

SEQ ID NO: 7513 - DNA, 33 bp, Artificial Sequence; identical to SEQ ID NO: 7355
  Description of Artificial Sequence: Synthetic oligonucleotide

SEQ ID NO: 7514 - protein, 11 aa, Artificial Sequence
  Description of Artificial Sequence: Synthetic peptide
RTSQSISSYLN

SEQ ID NO: 7515 - DNA, 48 bp, Artificial Sequence; identical to SEQ ID NO: 7353
  Description of Artificial Sequence: Synthetic oligonucleotide

SEQ ID NO: 7516 - protein, 16 aa, Artificial Sequence
  Description of Artificial Sequence: Synthetic peptide
RSSQSLLHRNGYNYLD

SEQ ID NO: 7517 - DNA, 48 bp, Artificial Sequence
  Description of Artificial Sequence: Synthetic oligonucleotide
aggtctagtcagagcctcctgcatagtactggatacaactatgtggat

SEQ ID NO: 7518 - protein, 16 aa, Artificial Sequence
  Description of Artificial Sequence: Synthetic peptide
RSSQSLLHSTGYNYVD

SEQ ID NO: 7519 - DNA, 33 bp, Artificial Sequence; identical to SEQ ID NO: 7355
  Description of Artificial Sequence: Synthetic oligonucleotide

SEQ ID NO: 7520 - protein, 11 aa, Artificial Sequence
  Description of Artificial Sequence: Synthetic peptide
RTSQSISSYLN

SEQ ID NO: 7521 - DNA, 33 bp, Artificial Sequence; identical to SEQ ID NO: 7355
  Description of Artificial Sequence: Synthetic oligonucleotide

SEQ ID NO: 7522 - protein, 11 aa, Artificial Sequence
  Description of Artificial Sequence: Synthetic peptide
RTSQSISSYLN

SEQ ID NO: 7523 - DNA, 33 bp, Artificial Sequence; identical to SEQ ID NO: 7355
  Description of Artificial Sequence: Synthetic oligonucleotide

SEQ ID NO: 7524 - protein, 11 aa, Artificial Sequence
  Description of Artificial Sequence: Synthetic peptide
RTSQSISSYLN

SEQ ID NO: 7525 - DNA, 48 bp, Artificial Sequence
  Description of Artificial Sequence: Synthetic oligonucleotide
aggtctagtcagagcctcctgcatagtagtggatacaactatttggat

SEQ ID NO: 7526 - protein, 16 aa, Artificial Sequence
  Description of Artificial Sequence: Synthetic peptide
RSSQSLLHSSGYNYLD

SEQ ID NO: 7527 - DNA, 48 bp, Artificial Sequence; identical to SEQ ID NO: 7335
  Description of Artificial Sequence: Synthetic oligonucleotide

SEQ ID NO: 7528 - protein, 16 aa, Artificial Sequence
  Description of Artificial Sequence: Synthetic peptide
RSSQSLLHRNGYNYLD

SEQ ID NO: 7529 - DNA, 48 bp, Artificial Sequence; identical to SEQ ID NO: 7341
  Description of Artificial Sequence: Synthetic oligonucleotide

SEQ ID NO: 7530 - protein, 16 aa, Artificial Sequence
  Description of Artificial Sequence: Synthetic peptide
RSSQSLLHRNGYNYLD

SEQ ID NO: 7531 - DNA, 33 bp, Artificial Sequence; identical to SEQ ID NO: 7235
  Description of Artificial Sequence: Synthetic oligonucleotide

SEQ ID NO: 7532 - protein, 11 aa, Artificial Sequence
  Description of Artificial Sequence: Synthetic peptide
RASQSISSYLN

SEQ ID NO: 7533 - protein, 11 aa, Artificial Sequence
  Description of Artificial Sequence: Synthetic peptide
GGNNIGSKSVH

SEQ ID NO: 7534 - protein, 11 aa, Artificial Sequence
  Description of Artificial Sequence: Synthetic peptide
GGNNIGSKSVH

SEQ ID NO: 7535 - protein, 11 aa, Artificial Sequence
  Description of Artificial Sequence: Synthetic peptide
RASQGISNYLA

SEQ ID NO: 7536 - protein, 11 aa, Artificial Sequence
  Description of Artificial Sequence: Synthetic peptide
GGNNIGSKSVH

SEQ ID NO: 7537 - protein, 16 aa, Artificial Sequence
  Description of Artificial Sequence: Synthetic peptide
RSSQSLLHRSGYNYLD

SEQ ID NO: 7538 - protein, 17 aa, Artificial Sequence
  Description of Artificial Sequence: Synthetic peptide
KSSQSVLYSSNNKNYLA

SEQ ID NO: 7539 - protein, 11 aa, Artificial Sequence
  Description of Artificial Sequence: Synthetic peptide
GGNNIGSKSVH

SEQ ID NO: 7540 - protein, 11 aa, Artificial Sequence
  Description of Artificial Sequence: Synthetic peptide
GGNNIGSKSVH

SEQ ID NO: 7541 - protein, 11 aa, Artificial Sequence
  Description of Artificial Sequence: Synthetic peptide
GGNNIGSKSVH

SEQ ID NO: 7542 - protein, 11 aa, Artificial Sequence
  Description of Artificial Sequence: Synthetic peptide
GGNNIGSKSVH

SEQ ID NO: 7543 - protein, 11 aa, Artificial Sequence
  Description of Artificial Sequence: Synthetic peptide
GGNNIGSKSVH

SEQ ID NO: 7544 - protein, 11 aa, Artificial Sequence
  Description of Artificial Sequence: Synthetic peptide
GGNNIGSKSVH

SEQ ID NO: 7545 - protein, 11 aa, Artificial Sequence
  Description of Artificial Sequence: Synthetic peptide
GGNNIGSKSVH

SEQ ID NO: 7546 - protein, 11 aa, Artificial Sequence
  Description of Artificial Sequence: Synthetic peptide
GGNNIGSKSVH

SEQ ID NO: 7547 - protein, 11 aa, Artificial Sequence
  Description of Artificial Sequence: Synthetic peptide
RTSQSISSYLN

SEQ ID NO: 7548 - protein, 11 aa, Artificial Sequence
  Description of Artificial Sequence: Synthetic peptide
QASQDISNYLN

SEQ ID NO: 7549 - protein, 11 aa, Artificial Sequence
  Description of Artificial Sequence: Synthetic peptide
QASQDISNYFN

SEQ ID NO: 7550 - protein, 11 aa, Artificial Sequence
  Description of Artificial Sequence: Synthetic peptide
QASQDISNYLN

SEQ ID NO: 7551 - protein, 11 aa, Artificial Sequence
  Description of Artificial Sequence: Synthetic peptide
QASQDISNYLN

SEQ ID NO: 7552 - protein, 11 aa, Artificial Sequence
  Description of Artificial Sequence: Synthetic peptide
RTSQSISSYLN

SEQ ID NO: 7553 - protein, 11 aa, Artificial Sequence
  Description of Artificial Sequence: Synthetic peptide
RTSQSISSYLN

SEQ ID NO: 7554 - protein, 11 aa, Artificial Sequence
  Description of Artificial Sequence: Synthetic peptide
RTSQSISSYLN

SEQ ID NO: 7555 - protein, 11 aa, Artificial Sequence
  Description of Artificial Sequence: Synthetic peptide
RTSQSISSYLN

SEQ ID NO: 7556 - protein, 11 aa, Artificial Sequence
  Description of Artificial Sequence: Synthetic peptide
GGNNIGSKSVH

SEQ ID NO: 7557 - protein, 11 aa, Artificial Sequence
  Description of Artificial Sequence: Synthetic peptide
GGNNIGSKSVH

SEQ ID NO: 7558 - protein, 11 aa, Artificial Sequence
  Description of Artificial Sequence: Synthetic peptide
RTSQSISSYLN

SEQ ID NO: 7559 - protein, 11 aa, Artificial Sequence
  Description of Artificial Sequence: Synthetic peptide
RTSQSISSYLN

SEQ ID NO: 7560 - protein, 11 aa, Artificial Sequence
  Description of Artificial Sequence: Synthetic peptide
RASQGISNYLA

SEQ ID NO: 7561 - DNA, 15 bp, Artificial Sequence
  Description of Artificial Sequence: Synthetic oligonucleotide
aagtcctggatgaac

SEQ ID NO: 7562 - protein, 5 aa, Artificial Sequence
  Description of Artificial Sequence: Synthetic peptide
KSWMN

SEQ ID NO: 7563 - DNA, 15 bp, Artificial Sequence
  Description of Artificial Sequence: Synthetic oligonucleotide
aagtcctggatgaac

SEQ ID NO: 7564 - protein, 5 aa, Artificial Sequence
  Description of Artificial Sequence: Synthetic peptide
KSWMN

SEQ ID NO: 7565 - DNA, 15 bp, Artificial Sequence
  Description of Artificial Sequence: Synthetic oligonucleotide
agctcctggatgaac

SEQ ID NO: 7566 - protein, 5 aa, Artificial Sequence
  Description of Artificial Sequence: Synthetic peptide
SSWMN

SEQ ID NO: 7567 - DNA, 15 bp, Artificial Sequence
  Description of Artificial Sequence: Synthetic oligonucleotide
agttatgatatcaac

SEQ ID NO: 7568 - protein, 5 aa, Artificial Sequence
  Description of Artificial Sequence: Synthetic peptide
SYDIN

SEQ ID NO: 7569 - DNA, 15 bp, Artificial Sequence
  Description of Artificial Sequence: Synthetic oligonucleotide
agttatgatatcaac

SEQ ID NO: 7570 - protein, 5 aa, Artificial Sequence
  Description of Artificial Sequence: Synthetic peptide
SYDIN

SEQ ID NO: 7571 - DNA, 15 bp, Artificial Sequence
  Description of Artificial Sequence: Synthetic oligonucleotide
ggttactactggaac

SEQ ID NO: 7572 - protein, 5 aa, Artificial Sequence
  Description of Artificial Sequence: Synthetic peptide
GYYWN

SEQ ID NO: 7573 - DNA, 15 bp, Artificial Sequence
  Description of Artificial Sequence: Synthetic oligonucleotide
agctatgccatgagc

SEQ ID NO: 7574 - protein, 5 aa, Artificial Sequence
  Description of Artificial Sequence: Synthetic peptide
SYAMS

SEQ ID NO: 7575 - DNA, 15 bp, Artificial Sequence
  Description of Artificial Sequence: Synthetic oligonucleotide
agctatcgcatgcac

SEQ ID NO: 7576 - protein, 5 aa, Artificial Sequence
  Description of Artificial Sequence: Synthetic peptide
SYRMH

SEQ ID NO: 7577 - DNA, 15 bp, Artificial Sequence
  Description of Artificial Sequence: Synthetic oligonucleotide
ggttactactggaac

SEQ ID NO: 7578 - protein, 5 aa, Artificial Sequence
  Description of Artificial Sequence: Synthetic peptide
GYYWN

SEQ ID NO: 7579 - DNA, 15 bp, Artificial Sequence
  Description of Artificial Sequence: Synthetic oligonucleotide
tcctatgccatgagc

SEQ ID NO: 7580 - protein, 5 aa, Artificial Sequence
  Description of Artificial Sequence: Synthetic peptide
SYAMS

SEQ ID NO: 7581 - DNA, 15 bp, Artificial Sequence
  Description of Artificial Sequence: Synthetic oligonucleotide
ggttatgatatcaac

SEQ ID NO: 7582 - protein, 5 aa, Artificial Sequence
  Description of Artificial Sequence: Synthetic peptide
GYDIN

SEQ ID NO: 7583 - DNA, 15 bp, Artificial Sequence
  Description of Artificial Sequence: Synthetic oligonucleotide
agctatgccatgagc

SEQ ID NO: 7584 - protein, 5 aa, Artificial Sequence
  Description of Artificial Sequence: Synthetic peptide
SYAMS

SEQ ID NO: 7585 - DNA, 15 bp, Artificial Sequence
  Description of Artificial Sequence: Synthetic oligonucleotide
ggttactactggacc

SEQ ID NO: 7586 - protein, 5 aa, Artificial Sequence
  Description of Artificial Sequence: Synthetic peptide
GYYWT

SEQ ID NO: 7587 - DNA, 15 bp, Artificial Sequence
  Description of Artificial Sequence: Synthetic oligonucleotide
ggttactactggaac

SEQ ID NO: 7588 - protein, 5 aa, Artificial Sequence
  Description of Artificial Sequence: Synthetic peptide
GYYWN

SEQ ID NO: 7589 - DNA, 15 bp, Artificial Sequence
  Description of Artificial Sequence: Synthetic oligonucleotide
ggttactactggaac

SEQ ID NO: 7590 - protein, 5 aa, Artificial Sequence
  Description of Artificial Sequence: Synthetic peptide
GYYWN

SEQ ID NO: 7591 - DNA, 15 bp, Artificial Sequence
  Description of Artificial Sequence: Synthetic oligonucleotide
ggttactactggagc

SEQ ID NO: 7592 - protein, 5 aa, Artificial Sequence
  Description of Artificial Sequence: Synthetic peptide
GYYWS

SEQ ID NO: 7593 - DNA, 15 bp, Artificial Sequence
  Description of Artificial Sequence: Synthetic oligonucleotide
agctatggcatgagc

SEQ ID NO: 7594 - protein, 5 aa, Artificial Sequence
  Description of Artificial Sequence: Synthetic peptide
SYGMS

SEQ ID NO: 7595 - DNA, 15 bp, Artificial Sequence
  Description of Artificial Sequence: Synthetic oligonucleotide
ggttactactggagc

SEQ ID NO: 7596 - protein, 5 aa, Artificial Sequence
  Description of Artificial Sequence: Synthetic peptide
GYYWS

SEQ ID NO: 7597 - DNA, 15 bp, Artificial Sequence
  Description of Artificial Sequence: Synthetic oligonucleotide
agttatgatatcaac

SEQ ID NO: 7598 - protein, 5 aa, Artificial Sequence
  Description of Artificial Sequence: Synthetic peptide
SYDIN

SEQ ID NO: 7599 - DNA, 15 bp, Artificial Sequence
  Description of Artificial Sequence: Synthetic oligonucleotide
ggttactactggaac

SEQ ID NO: 7600 - protein, 5 aa, Artificial Sequence
  Description of Artificial Sequence: Synthetic peptide
GYYWN

SEQ ID NO: 7601 - DNA, 15 bp, Artificial Sequence
  Description of Artificial Sequence: Synthetic oligonucleotide
ggtttctactggaac

SEQ ID NO: 7602 - protein, 5 aa, Artificial Sequence
  Description of Artificial Sequence: Synthetic peptide
GFYWN

SEQ ID NO: 7603 - DNA, 15 bp, Artificial Sequence
  Description of Artificial Sequence: Synthetic oligonucleotide
ggttactactggaac

SEQ ID NO: 7604 - protein, 5 aa, Artificial Sequence
  Description of Artificial Sequence: Synthetic peptide
GYYWN

SEQ ID NO: 7605 - DNA, 15 bp, Artificial Sequence
  Description of Artificial Sequence: Synthetic oligonucleotide
ggttactactggagc

SEQ ID NO: 7606 - protein, 5 aa, Artificial Sequence
  Description of Artificial Sequence: Synthetic peptide
GYYWS

SEQ ID NO: 7607 - DNA, 15 bp, Artificial Sequence
  Description of Artificial Sequence: Synthetic oligonucleotide
ggttactactggagc

SEQ ID NO: 7608 - protein, 5 aa, Artificial Sequence
  Description of Artificial Sequence: Synthetic peptide
GYYWS

SEQ ID NO: 7609 - DNA, 15 bp, Artificial Sequence
  Description of Artificial Sequence: Synthetic oligonucleotide
agctatgccatgagc

SEQ ID NO: 7610 - protein, 5 aa, Artificial Sequence
  Description of Artificial Sequence: Synthetic peptide
SYAMS

SEQ ID NO: 7611 - DNA, 15 bp, Artificial Sequence
  Description of Artificial Sequence: Synthetic oligonucleotide
agctatggcatgagc

SEQ ID NO: 7612 - protein, 5 aa, Artificial Sequence
  Description of Artificial Sequence: Synthetic peptide
SYGMS

SEQ ID NO: 7613 - DNA, 15 bp, Artificial Sequence
  Description of Artificial Sequence: Synthetic oligonucleotide
ggttactactggagc

SEQ ID NO: 7614 - protein, 5 aa, Artificial Sequence
  Description of Artificial Sequence: Synthetic peptide
GYYWS

SEQ ID NO: 7615 - DNA, 21 bp, Artificial Sequence
  Description of Artificial Sequence: Synthetic oligonucleotide
cgtgatccttactactggagc

SEQ ID NO: 7616 - protein, 7 aa, Artificial Sequence
  Description of Artificial Sequence: Synthetic peptide
RDPYYWS

SEQ ID NO: 7617 - DNA, 15 bp, Artificial Sequence
  Description of Artificial Sequence: Synthetic oligonucleotide
ggttactactggagc

SEQ ID NO: 7618 - protein, 5 aa, Artificial Sequence
  Description of Artificial Sequence: Synthetic peptide
GYYWS

SEQ ID NO: 7619 - DNA, 15 bp, Artificial Sequence
  Description of Artificial Sequence: Synthetic oligonucleotide
ggttactactggaac

SEQ ID NO: 7620 - protein, 5 aa, Artificial Sequence
  Description of Artificial Sequence: Synthetic peptide
GYYWN

SEQ ID NO: 7621 - DNA, 15 bp, Artificial Sequence
  Description of Artificial Sequence: Synthetic oligonucleotide
agctttgccatgagc

SEQ ID NO: 7622 - protein, 5 aa, Artificial Sequence
  Description of Artificial Sequence: Synthetic peptide
SFAMS

SEQ ID NO: 7623 - DNA, 15 bp, Artificial Sequence
  Description of Artificial Sequence: Synthetic oligonucleotide
ggttactactggagc

SEQ ID NO: 7624 - protein, 5 aa, Artificial Sequence
  Description of Artificial Sequence: Synthetic peptide
GYYWS

SEQ ID NO: 7625 - DNA, 15 bp, Artificial Sequence
  Description of Artificial Sequence: Synthetic oligonucleotide
ggttactactggagc

SEQ ID NO: 7626 - protein, 5 aa, Artificial Sequence
  Description of Artificial Sequence: Synthetic peptide
GYYWS

SEQ ID NO: 7627 - DNA, 15 bp, Artificial Sequence
  Description of Artificial Sequence: Synthetic oligonucleotide
ggttactactggaac

SEQ ID NO: 7628 - protein, 5 aa, Artificial Sequence
  Description of Artificial Sequence: Synthetic peptide
GYYWN

SEQ ID NO: 7629 - DNA, 15 bp, Artificial Sequence
  Description of Artificial Sequence: Synthetic oligonucleotide
agttatgatatcaac

SEQ ID NO: 7630 - protein, 5 aa, Artificial Sequence
  Description of Artificial Sequence: Synthetic peptide
SYDIN

SEQ ID NO: 7631 - DNA, 15 bp, Artificial Sequence
  Description of Artificial Sequence: Synthetic oligonucleotide
agatacggcatggac

SEQ ID NO: 7632 - protein, 5 aa, Artificial Sequence
  Description of Artificial Sequence: Synthetic peptide
RYGMD

SEQ ID NO: 7633 - DNA, 15 bp, Artificial Sequence
  Description of Artificial Sequence: Synthetic oligonucleotide
agttatgatatcaac

SEQ ID NO: 7634 - protein, 5 aa, Artificial Sequence
  Description of Artificial Sequence: Synthetic peptide
SYDIN

SEQ ID NO: 7635 - DNA, 15 bp, Artificial Sequence
  Description of Artificial Sequence: Synthetic oligonucleotide
agttatgatatcaac

SEQ ID NO: 7636 - protein, 5 aa, Artificial Sequence
  Description of Artificial Sequence: Synthetic peptide
SYDIN

SEQ ID NO: 7637 - DNA, 15 bp, Artificial Sequence
  Description of Artificial Sequence: Synthetic oligonucleotide
agctatgccatgagc

SEQ ID NO: 7638 - protein, 5 aa, Artificial Sequence
  Description of Artificial Sequence: Synthetic peptide
SYAMS

SEQ ID NO: 7639 - DNA, 15 bp, Artificial Sequence
  Description of Artificial Sequence: Synthetic oligonucleotide
ggctatagcatgaac

SEQ ID NO: 7640 - protein, 5 aa, Artificial Sequence
  Description of Artificial Sequence: Synthetic peptide
GYSMN

SEQ ID NO: 7641 - DNA, 15 bp, Artificial Sequence
  Description of Artificial Sequence: Synthetic oligonucleotide
tcctatgccatgagc

SEQ ID NO: 7642 - protein, 5 aa, Artificial Sequence
  Description of Artificial Sequence: Synthetic peptide
SYAMS

SEQ ID NO: 7643 - DNA, 15 bp, Artificial Sequence
  Description of Artificial Sequence: Synthetic oligonucleotide
agatatggcatgcag

SEQ ID NO: 7644 - protein, 5 aa, Artificial Sequence
  Description of Artificial Sequence: Synthetic peptide
RYGMQ

SEQ ID NO: 7645 - DNA, 15 bp, Artificial Sequence
  Description of Artificial Sequence: Synthetic oligonucleotide
agctatggcatgcac

SEQ ID NO: 7646 - protein, 5 aa, Artificial Sequence
  Description of Artificial Sequence: Synthetic peptide
SYGMH

SEQ ID NO: 7647 - DNA, 15 bp, Artificial Sequence
  Description of Artificial Sequence: Synthetic oligonucleotide
agttatgatatcaac

SEQ ID NO: 7648 - protein, 5 aa, Artificial Sequence
  Description of Artificial Sequence: Synthetic peptide
SYDIN

SEQ ID NO: 7649 - DNA, 15 bp, Artificial Sequence
  Description of Artificial Sequence: Synthetic oligonucleotide
agttatgatatcaac

SEQ ID NO: 7650 - protein, 5 aa, Artificial Sequence
  Description of Artificial Sequence: Synthetic peptide
SYDIN

SEQ ID NO: 7651 - DNA, 21 bp, Artificial Sequence
  Description of Artificial Sequence: Synthetic oligonucleotide
agtggtgattactactggagc

SEQ ID NO: 7652 - protein, 7 aa, Artificial Sequence
  Description of Artificial Sequence: Synthetic peptide
SGDYYWS

SEQ ID NO: 7653 - DNA, 15 bp, Artificial Sequence
  Description of Artificial Sequence: Synthetic oligonucleotide
agctatgccatgagc

SEQ ID NO: 7654 - protein, 5 aa, Artificial Sequence
  Description of Artificial Sequence: Synthetic peptide
SYAMS

SEQ ID NO: 7655 - DNA, 21 bp, Artificial Sequence
  Description of Artificial Sequence: Synthetic oligonucleotide
agtagtcgttactactggggc

SEQ ID NO: 7656 - protein, 7 aa, Artificial Sequence
  Description of Artificial Sequence: Synthetic peptide
SSRYYWG

SEQ ID NO: 7657 - DNA, 21 bp, Artificial Sequence
  Description of Artificial Sequence: Synthetic oligonucleotide
agcaacagtgctgcttggaac

SEQ ID NO: 7658 - protein, 7 aa, Artificial Sequence
  Description of Artificial Sequence: Synthetic peptide
SNSAAWN

SEQ ID NO: 7659 - DNA, 21 bp, Artificial Sequence
  Description of Artificial Sequence: Synthetic oligonucleotide
agtagtaggtcctactggggc

SEQ ID NO: 7660 - protein, 7 aa, Artificial Sequence
  Description of Artificial Sequence: Synthetic peptide
SSRSYWG

SEQ ID NO: 7661 - DNA, 21 bp, Artificial Sequence
  Description of Artificial Sequence: Synthetic oligonucleotide
actcataaaatgggtgtggac

SEQ ID NO: 7662 - protein, 7 aa, Artificial Sequence
  Description of Artificial Sequence: Synthetic peptide
THKMGVD

SEQ ID NO: 7663 - DNA, 15 bp, Artificial Sequence
  Description of Artificial Sequence: Synthetic oligonucleotide
atctatgccttgagc

SEQ ID NO: 7664 - protein, 5 aa, Artificial Sequence
  Description of Artificial Sequence: Synthetic peptide
IYALS

SEQ ID NO: 7665 - DNA, 15 bp, Artificial Sequence
  Description of Artificial Sequence: Synthetic oligonucleotide
agatatggcatggat

SEQ ID NO: 7666 - protein, 5 aa, Artificial Sequence
  Description of Artificial Sequence: Synthetic peptide
RYGMD

SEQ ID NO: 7667 - DNA, 15 bp, Artificial Sequence
  Description of Artificial Sequence: Synthetic oligonucleotide
agctatgccatgagc

SEQ ID NO: 7668 - protein, 5 aa, Artificial Sequence
  Description of Artificial Sequence: Synthetic peptide
SYAMS

SEQ ID NO: 7669 - DNA, 15 bp, Artificial Sequence
  Description of Artificial Sequence: Synthetic oligonucleotide
agttatgatatcaac

SEQ ID NO: 7670 - protein, 5 aa, Artificial Sequence
  Description of Artificial Sequence: Synthetic peptide
SYDIN

SEQ ID NO: 7671 - DNA, 15 bp, Artificial Sequence
  Description of Artificial Sequence: Synthetic oligonucleotide
agctatgccatgagc

SEQ ID NO: 7672 - protein, 5 aa, Artificial Sequence
  Description of Artificial Sequence: Synthetic peptide
SYAMS

SEQ ID NO: 7673 - DNA, 15 bp, Artificial Sequence
  Description of Artificial Sequence: Synthetic oligonucleotide
ggttactactggagc

SEQ ID NO: 7674 - protein, 5 aa, Artificial Sequence
  Description of Artificial Sequence: Synthetic peptide
GYYWS

SEQ ID NO: 7675 - DNA, 21 bp, Artificial Sequence
  Description of Artificial Sequence: Synthetic oligonucleotide
agtagtaggtcctactggggc

SEQ ID NO: 7676 - protein, 7 aa, Artificial Sequence
  Description of Artificial Sequence: Synthetic peptide
SSRSYWG

SEQ ID NO: 7677 - DNA, 21 bp, Artificial Sequence
  Description of Artificial Sequence: Synthetic oligonucleotide
actaataaaatggctgtgggt

SEQ ID NO: 7678 - protein, 7 aa, Artificial Sequence
  Description of Artificial Sequence: Synthetic peptide
TNKMAVG

SEQ ID NO: 7679 - DNA, 21 bp, Artificial Sequence
  Description of Artificial Sequence: Synthetic oligonucleotide
actcataaaatgggtgtggac

SEQ ID NO: 7680 - protein, 7 aa, Artificial Sequence
  Description of Artificial Sequence: Synthetic peptide
THKMGVD

SEQ ID NO: 7681 - DNA, 15 bp, Artificial Sequence
  Description of Artificial Sequence: Synthetic oligonucleotide
agctatgccatgagc

SEQ ID NO: 7682 - protein, 5 aa, Artificial Sequence
  Description of Artificial Sequence: Synthetic peptide
SYAMS

SEQ ID NO: 7683 - DNA, 15 bp, Artificial Sequence
  Description of Artificial Sequence: Synthetic oligonucleotide
agctatgccgtgagc

SEQ ID NO: 7684 - protein, 5 aa, Artificial Sequence
  Description of Artificial Sequence: Synthetic peptide
SYAVS

SEQ ID NO: 7685 - DNA, 15 bp, Artificial Sequence
  Description of Artificial Sequence: Synthetic oligonucleotide
aactatgccatgagc

SEQ ID NO: 7686 - protein, 5 aa, Artificial Sequence
  Description of Artificial Sequence: Synthetic peptide
NYAMS

SEQ ID NO: 7687 - DNA, 15 bp, Artificial Sequence
  Description of Artificial Sequence: Synthetic oligonucleotide
agatatggcatggat

SEQ ID NO: 7688 - protein, 5 aa, Artificial Sequence
  Description of Artificial Sequence: Synthetic peptide
RYGMD

SEQ ID NO: 7689 - DNA, 15 bp, Artificial Sequence
  Description of Artificial Sequence: Synthetic oligonucleotide
tcctatgccatgagc

SEQ ID NO: 7690 - protein, 5 aa, Artificial Sequence
  Description of Artificial Sequence: Synthetic peptide
SYAMS

SEQ ID NO: 7691 - DNA, 15 bp, Artificial Sequence
  Description of Artificial Sequence: Synthetic oligonucleotide
atctatggcatgagc

SEQ ID NO: 7692 - protein, 5 aa, Artificial Sequence
  Description of Artificial Sequence: Synthetic peptide
IYGMS

SEQ ID NO: 7693 - DNA, 21 bp, Artificial Sequence
  Description of Artificial Sequence: Synthetic oligonucleotide
agtaatccttactactggagc

SEQ ID NO: 7694 - protein, 7 aa, Artificial Sequence
  Description of Artificial Sequence: Synthetic peptide
SNPYYWS

SEQ ID NO: 7695 - DNA, 21 bp, Artificial Sequence
  Description of Artificial Sequence: Synthetic oligonucleotide
agtggtgattactactggagc

SEQ ID NO: 7696 - protein, 7 aa, Artificial Sequence
  Description of Artificial Sequence: Synthetic peptide
SGDYYWS

SEQ ID NO: 7697 - DNA, 21 bp, Artificial Sequence
  Description of Artificial Sequence: Synthetic oligonucleotide
agtggtgattactactggagc

SEQ ID NO: 7698 - protein, 7 aa, Artificial Sequence
  Description of Artificial Sequence: Synthetic peptide
SGDYYWS

SEQ ID NO: 7699 - DNA, 21 bp, Artificial Sequence
  Description of Artificial Sequence: Synthetic oligonucleotide
agtggtgattactactggagc

SEQ ID NO: 7700 - protein, 7 aa, Artificial Sequence
  Description of Artificial Sequence: Synthetic peptide
SGDYYWS

SEQ ID NO: 7701 - DNA, 15 bp, Artificial Sequence
  Description of Artificial Sequence: Synthetic oligonucleotide
aacgcctggatgagc

SEQ ID NO: 7702 - protein, 5 aa, Artificial Sequence
  Description of Artificial Sequence: Synthetic peptide
NAWMS

SEQ ID NO: 7703 - DNA, 15 bp, Artificial Sequence
  Description of Artificial Sequence: Synthetic oligonucleotide
aacgcctggatgagc

SEQ ID NO: 7704 - protein, 5 aa, Artificial Sequence
  Description of Artificial Sequence: Synthetic peptide
NAWMS

SEQ ID NO: 7705 - DNA, 21 bp, Artificial Sequence
  Description of Artificial Sequence: Synthetic oligonucleotide
agtggtgattactactggagc

SEQ ID NO: 7706 - protein, 7 aa, Artificial Sequence
  Description of Artificial Sequence: Synthetic peptide
SGDYYWS

SEQ ID NO: 7707 - DNA, 21 bp, Artificial Sequence
  Description of Artificial Sequence: Synthetic oligonucleotide
agtggtgattactactggagc

SEQ ID NO: 7708 - protein, 7 aa, Artificial Sequence
  Description of Artificial Sequence: Synthetic peptide
SGDYYWS

SEQ ID NO: 7709 - DNA, 21 bp, Artificial Sequence
  Description of Artificial Sequence: Synthetic oligonucleotide
agtaatccttactactggagc

SEQ ID NO: 7710 - protein, 7 aa, Artificial Sequence
  Description of Artificial Sequence: Synthetic peptide
SNPYYWS

SEQ ID NO: 7711 - DNA, 21 bp, Artificial Sequence
  Description of Artificial Sequence: Synthetic oligonucleotide
agtaatccttactactggagc

SEQ ID NO: 7712 - protein, 7 aa, Artificial Sequence
  Description of Artificial Sequence: Synthetic peptide
SNPYYWS

SEQ ID NO: 7713 - DNA, 15 bp, Artificial Sequence
  Description of Artificial Sequence: Synthetic oligonucleotide
aacgcctggatgagc

SEQ ID NO: 7714 - protein, 5 aa, Artificial Sequence
  Description of Artificial Sequence: Synthetic peptide
NAWMS

SEQ ID NO: 7715 - DNA, 15 bp, Artificial Sequence
  Description of Artificial Sequence: Synthetic oligonucleotide
aacgcctggatgagc

SEQ ID NO: 7716 - protein, 5 aa, Artificial Sequence
  Description of Artificial Sequence: Synthetic peptide
NAWMS

SEQ ID NO: 7717 - DNA, 15 bp, Artificial Sequence
  Description of Artificial Sequence: Synthetic oligonucleotide
aacgcctggatgagc

SEQ ID NO: 7718 - protein, 5 aa, Artificial Sequence
  Description of Artificial Sequence: Synthetic peptide
NAWMS

SEQ ID NO: 7719 - DNA, 15 bp, Artificial Sequence
  Description of Artificial Sequence: Synthetic oligonucleotide
agttactactggagc

SEQ ID NO: 7720 - protein, 5 aa, Artificial Sequence
  Description of Artificial Sequence: Synthetic peptide
SYYWS

SEQ ID NO: 7721 - DNA, 21 bp, Artificial Sequence
  Description of Artificial Sequence: Synthetic oligonucleotide
agtaatccttactactggagc

SEQ ID NO: 7722 - protein, 7 aa, Artificial Sequence
  Description of Artificial Sequence: Synthetic peptide
SNPYYWS

SEQ ID NO: 7723 - DNA, 21 bp, Artificial Sequence
  Description of Artificial Sequence: Synthetic oligonucleotide
agtggtgattactactggagc

SEQ ID NO: 7724 - protein, 7 aa, Artificial Sequence
  Description of Artificial Sequence: Synthetic peptide
SGDYYWS

SEQ ID NO: 7725 - DNA, 15 bp, Artificial Sequence
  Description of Artificial Sequence: Synthetic oligonucleotide
gatttcttctggagc

SEQ ID NO: 7726 - protein, 5 aa, Artificial Sequence
  Description of Artificial Sequence: Synthetic peptide
DFFWS

SEQ ID NO: 7727 - DNA, 21 bp, Artificial Sequence
  Description of Artificial Sequence: Synthetic oligonucleotide
agtggtgattactactggagc

SEQ ID NO: 7728 - protein, 7 aa, Artificial Sequence
  Description of Artificial Sequence: Synthetic peptide
SGDYYWS

SEQ ID NO: 7729 - DNA, 21 bp, Artificial Sequence
  Description of Artificial Sequence: Synthetic oligonucleotide
agtaatccttactactggagc

SEQ ID NO: 7730 - protein, 7 aa, Artificial Sequence
  Description of Artificial Sequence: Synthetic peptide
SNPYYWS

SEQ ID NO: 7731 - DNA, 21 bp, Artificial Sequence
  Description of Artificial Sequence: Synthetic oligonucleotide
agtggtgattactactggagc

SEQ ID NO: 7732 - protein, 7 aa, Artificial Sequence
  Description of Artificial Sequence: Synthetic peptide
SGDYYWS

SEQ ID NO: 7733 - DNA, 21 bp, Artificial Sequence
  Description of Artificial Sequence: Synthetic oligonucleotide
agtaatccttactactggagc

SEQ ID NO: 7734 - protein, 7 aa, Artificial Sequence
  Description of Artificial Sequence: Synthetic peptide
SNPYYWS

SEQ ID NO: 7735 - DNA, 21 bp, Artificial Sequence
  Description of Artificial Sequence: Synthetic oligonucleotide
agtaatccttactactggagc

SEQ ID NO: 7736 - protein, 7 aa, Artificial Sequence
  Description of Artificial Sequence: Synthetic peptide
SNPYYWS

SEQ ID NO: 7737 - DNA, 21 bp, Artificial Sequence
  Description of Artificial Sequence: Synthetic oligonucleotide
agtaatccttactactggagc

SEQ ID NO: 7738 - protein, 7 aa, Artificial Sequence
  Description of Artificial Sequence: Synthetic peptide
SNPYYWS

SEQ ID NO: 7739 - DNA, 15 bp, Artificial Sequence
  Description of Artificial Sequence: Synthetic oligonucleotide
aacgcctggatgagc

SEQ ID NO: 7740 - protein, 5 aa, Artificial Sequence
  Description of Artificial Sequence: Synthetic peptide
NAWMS

SEQ ID NO: 7741 - DNA, 15 bp, Artificial Sequence
  Description of Artificial Sequence: Synthetic oligonucleotide
aattactactggagc

SEQ ID NO: 7742 - protein, 5 aa, Artificial Sequence
  Description of Artificial Sequence: Synthetic peptide
NYYWS

SEQ ID NO: 7743 - DNA, 15 bp, Artificial Sequence
  Description of Artificial Sequence: Synthetic oligonucleotide
agctatgccatgagc

SEQ ID NO: 7744 - protein, 5 aa, Artificial Sequence
  Description of Artificial Sequence: Synthetic peptide
SYAMS

SEQ ID NO: 7745 - DNA, 15 bp, Artificial Sequence
  Description of Artificial Sequence: Synthetic oligonucleotide
agccatgccatgagc

SEQ ID NO: 7746 - protein, 5 aa, Artificial Sequence
  Description of Artificial Sequence: Synthetic peptide
SHAMS

SEQ ID NO: 7747 - DNA, 15 bp, Artificial Sequence
  Description of Artificial Sequence: Synthetic oligonucleotide
agctatgccatgagc

SEQ ID NO: 7748 - protein, 5 aa, Artificial Sequence
  Description of Artificial Sequence: Synthetic peptide
SYAMS

SEQ ID NO: 7749 - DNA, 15 bp, Artificial Sequence
  Description of Artificial Sequence: Synthetic oligonucleotide
agctatgccatgagc

SEQ ID NO: 7750 - protein, 5 aa, Artificial Sequence
  Description of Artificial Sequence: Synthetic peptide
SYAMS

SEQ ID NO: 7751 - DNA, 15 bp, Artificial Sequence
  Description of Artificial Sequence: Synthetic oligonucleotide
agccatgccatgagc

SEQ ID NO: 7752 - protein, 5 aa, Artificial Sequence
  Description of Artificial Sequence: Synthetic peptide
SHAMS

SEQ ID NO: 7753 - DNA, 15 bp, Artificial Sequence
  Description of Artificial Sequence: Synthetic oligonucleotide
agctatgccatgagc

SEQ ID NO: 7754 - protein, 5 aa, Artificial Sequence
  Description of Artificial Sequence: Synthetic peptide
SYAMS

SEQ ID NO: 7755 - DNA, 15 bp, Artificial Sequence
  Description of Artificial Sequence: Synthetic oligonucleotide
agccatgccatgagc

SEQ ID NO: 7756 - protein, 5 aa, Artificial Sequence
  Description of Artificial Sequence: Synthetic peptide
SHAMS

SEQ ID NO: 7757 - DNA, 15 bp, Artificial Sequence
  Description of Artificial Sequence: Synthetic oligonucleotide
agctatgccatgagc

SEQ ID NO: 7758 - protein, 5 aa, Artificial Sequence
  Description of Artificial Sequence: Synthetic peptide
SYAMS

SEQ ID NO: 7759 - DNA, 15 bp, Artificial Sequence
  Description of Artificial Sequence: Synthetic oligonucleotide
agctatgccatgagc

SEQ ID NO: 7760 - protein, 5 aa, Artificial Sequence
  Description of Artificial Sequence: Synthetic peptide
SYAMS

SEQ ID NO: 7761 - DNA, 15 bp, Artificial Sequence
  Description of Artificial Sequence: Synthetic oligonucleotide
agctatgccatgagc

SEQ ID NO: 7762 - protein, 5 aa, Artificial Sequence
  Description of Artificial Sequence: Synthetic peptide
SYAMS

SEQ ID NO: 7763 - DNA, 15 bp, Artificial Sequence
  Description of Artificial Sequence: Synthetic oligonucleotide
agctatgccatgaac

SEQ ID NO: 7764 - protein, 5 aa, Artificial Sequence
  Description of Artificial Sequence: Synthetic peptide
SYAMN

SEQ ID NO: 7765 - DNA, 15 bp, Artificial Sequence
  Description of Artificial Sequence: Synthetic oligonucleotide
agctatgccatgagc

SEQ ID NO: 7766 - protein, 5 aa, Artificial Sequence
  Description of Artificial Sequence: Synthetic peptide
SYAMS

SEQ ID NO: 7767 - DNA, 15 bp, Artificial Sequence
  Description of Artificial Sequence: Synthetic oligonucleotide
agccatgccatgagc

SEQ ID NO: 7768 - protein, 5 aa, Artificial Sequence
  Description of Artificial Sequence: Synthetic peptide
SHAMS

SEQ ID NO: 7769 - DNA, 15 bp, Artificial Sequence
  Description of Artificial Sequence: Synthetic oligonucleotide
agctatgccatgagc

SEQ ID NO: 7770 - protein, 5 aa, Artificial Sequence
  Description of Artificial Sequence: Synthetic peptide
SYAMS

SEQ ID NO: 7771 - DNA, 15 bp, Artificial Sequence
  Description of Artificial Sequence: Synthetic oligonucleotide
agctatgccatgagc

SEQ ID NO: 7772 - protein, 5 aa, Artificial Sequence
  Description of Artificial Sequence: Synthetic peptide
SYAMS

SEQ ID NO: 7773 - DNA, 15 bp, Artificial Sequence
  Description of Artificial Sequence: Synthetic oligonucleotide
agctatgccatgagc

SEQ ID NO: 7774 - protein, 5 aa, Artificial Sequence
  Description of Artificial Sequence: Synthetic peptide
SYAMS

SEQ ID NO: 7775 - DNA, 15 bp, Artificial Sequence
  Description of Artificial Sequence: Synthetic oligonucleotide
agctatgccatgagc

SEQ ID NO: 7776 - protein, 5 aa, Artificial Sequence
  Description of Artificial Sequence: Synthetic peptide
SYAMS

SEQ ID NO: 7777 - DNA, 15 bp, Artificial Sequence
  Description of Artificial Sequence: Synthetic oligonucleotide
agctatgccatgagc

SEQ ID NO: 7778 - protein, 5 aa, Artificial Sequence
  Description of Artificial Sequence: Synthetic peptide
SYAMS

SEQ ID NO: 7779 - DNA, 15 bp, Artificial Sequence
  Description of Artificial Sequence: Synthetic oligonucleotide
agctatgccatgagc

SEQ ID NO: 7780 - protein, 5 aa, Artificial Sequence
  Description of Artificial Sequence: Synthetic peptide
SYAMS

SEQ ID NO: 7781 - DNA, 15 bp, Artificial Sequence
  Description of Artificial Sequence: Synthetic oligonucleotide
agctatgccatgagc

SEQ ID NO: 7782 - protein, 5 aa, Artificial Sequence
  Description of Artificial Sequence: Synthetic peptide
SYAMS

SEQ ID NO: 7783 - DNA, 15 bp, Artificial Sequence
  Description of Artificial Sequence: Synthetic oligonucleotide
agctatgccatgaac

SEQ ID NO: 7784 - protein, 5 aa, Artificial Sequence
  Description of Artificial Sequence: Synthetic peptide
SYAMN

SEQ ID NO: 7785 - DNA, 15 bp, Artificial Sequence
  Description of Artificial Sequence: Synthetic oligonucleotide
agctatgccatgagc

SEQ ID NO: 7786 - protein, 5 aa, Artificial Sequence
  Description of Artificial Sequence: Synthetic peptide
SYAMS

SEQ ID NO: 7787 - DNA, 15 bp, Artificial Sequence
  Description of Artificial Sequence: Synthetic oligonucleotide
agctatgccatgagc

SEQ ID NO: 7788 - protein, 5 aa, Artificial Sequence
  Description of Artificial Sequence: Synthetic peptide
SYAMS

SEQ ID NO: 7789 - DNA, 15 bp, Artificial Sequence
  Description of Artificial Sequence: Synthetic oligonucleotide
agctatgccatgagc

SEQ ID NO: 7790 - protein, 5 aa, Artificial Sequence
  Description of Artificial Sequence: Synthetic peptide
SYAMS

SEQ ID NO: 7791 - DNA, 15 bp, Artificial Sequence
  Description of Artificial Sequence: Synthetic oligonucleotide
agctatgccatgagc

SEQ ID NO: 7792 - protein, 5 aa, Artificial Sequence
  Description of Artificial Sequence: Synthetic peptide
SYAMS

SEQ ID NO: 7793 - DNA, 15 bp, Artificial Sequence
  Description of Artificial Sequence: Synthetic oligonucleotide
agctatgccatgagc

SEQ ID NO: 7794 - protein, 5 aa, Artificial Sequence
  Description of Artificial Sequence: Synthetic peptide
SYAMS

SEQ ID NO: 7795 - DNA, 15 bp, Artificial Sequence
  Description of Artificial Sequence: Synthetic oligonucleotide
agctatgccatgagc

SEQ ID NO: 7796 - protein, 5 aa, Artificial Sequence
  Description of Artificial Sequence: Synthetic peptide
SYAMS

SEQ ID NO: 7797 - DNA, 15 bp, Artificial Sequence
  Description of Artificial Sequence: Synthetic oligonucleotide
agctatgccatgagc

SEQ ID NO: 7798 - protein, 5 aa, Artificial Sequence
  Description of Artificial Sequence: Synthetic peptide
SYAMS

SEQ ID NO: 7799 - DNA, 15 bp, Artificial Sequence
  Description of Artificial Sequence: Synthetic oligonucleotide
agctatgccatgcac

SEQ ID NO: 7800 - protein, 5 aa, Artificial Sequence
  Description of Artificial Sequence: Synthetic peptide
SYAMH

SEQ ID NO: 7801 - DNA, 15 bp, Artificial Sequence
  Description of Artificial Sequence: Synthetic oligonucleotide
agctatgccatgacc

SEQ ID NO: 7802 - protein, 5 aa, Artificial Sequence
  Description of Artificial Sequence: Synthetic peptide
SYAMT

SEQ ID NO: 7803 - DNA, 15 bp, Artificial Sequence
  Description of Artificial Sequence: Synthetic oligonucleotide
agctatgccatgagc

SEQ ID NO: 7804 - protein, 5 aa, Artificial Sequence
  Description of Artificial Sequence: Synthetic peptide
SYAMS

SEQ ID NO: 7805 - DNA, 15 bp, Artificial Sequence
  Description of Artificial Sequence: Synthetic oligonucleotide
agctatgccatgagc

SEQ ID NO: 7806 - protein, 5 aa, Artificial Sequence
  Description of Artificial Sequence: Synthetic peptide
SYAMS

SEQ ID NO: 7807 - DNA, 15 bp, Artificial Sequence
  Description of Artificial Sequence: Synthetic oligonucleotide
agctatgccatgagc

SEQ ID NO: 7808 - protein, 5 aa, Artificial Sequence
  Description of Artificial Sequence: Synthetic peptide
SYAMS

SEQ ID NO: 7809 - DNA, 15 bp, Artificial Sequence
  Description of Artificial Sequence: Synthetic oligonucleotide
agccatgccatgagc

SEQ ID NO: 7810 - protein, 5 aa, Artificial Sequence
  Description of Artificial Sequence: Synthetic peptide
SHAMS

SEQ ID NO: 7811 - DNA, 15 bp, Artificial Sequence
  Description of Artificial Sequence: Synthetic oligonucleotide
acctatggcatgcac

SEQ ID NO: 7812 - protein, 5 aa, Artificial Sequence
  Description of Artificial Sequence: Synthetic peptide
TYGMH

SEQ ID NO: 7813 - DNA, 15 bp, Artificial Sequence
  Description of Artificial Sequence: Synthetic oligonucleotide
aggaatggtctcagc

SEQ ID NO: 7814 - protein, 5 aa, Artificial Sequence
  Description of Artificial Sequence: Synthetic peptide
RNGLS

SEQ ID NO: 7815 - DNA, 15 bp, Artificial Sequence
  Description of Artificial Sequence: Synthetic oligonucleotide
aggaatggtctcagc

SEQ ID NO: 7816 - protein, 5 aa, Artificial Sequence
  Description of Artificial Sequence: Synthetic peptide
RNGLS

SEQ ID NO: 7817 - DNA, 15 bp, Artificial Sequence
  Description of Artificial Sequence: Synthetic oligonucleotide
gactactacatgagc

SEQ ID NO: 7818 - protein, 5 aa, Artificial Sequence
  Description of Artificial Sequence: Synthetic peptide
DYYMS

SEQ ID NO: 7819 - DNA, 15 bp, Artificial Sequence
  Description of Artificial Sequence: Synthetic oligonucleotide
agccatgccatgagc

SEQ ID NO: 7820 - protein, 5 aa, Artificial Sequence
  Description of Artificial Sequence: Synthetic peptide
SHAMS

SEQ ID NO: 7821 - DNA, 15 bp, Artificial Sequence
  Description of Artificial Sequence: Synthetic oligonucleotide
agccatgccatgagc

SEQ ID NO: 7822 - protein, 5 aa, Artificial Sequence
  Description of Artificial Sequence: Synthetic peptide
SHAMS

SEQ ID NO: 7823 - DNA, 15 bp, Artificial Sequence
  Description of Artificial Sequence: Synthetic oligonucleotide
agctatgccatgagc

SEQ ID NO: 7824 - protein, 5 aa, Artificial Sequence
  Description of Artificial Sequence: Synthetic peptide
SYAMS

SEQ ID NO: 7825 - DNA, 15 bp, Artificial Sequence
  Description of Artificial Sequence: Synthetic oligonucleotide
agctatgccatgagc

SEQ ID NO: 7826 - protein, 5 aa, Artificial Sequence
  Description of Artificial Sequence: Synthetic peptide
SYAMS

SEQ ID NO: 7827 - DNA, 15 bp, Artificial Sequence
  Description of Artificial Sequence: Synthetic oligonucleotide
agccatgccatgagc

SEQ ID NO: 7828 - protein, 5 aa, Artificial Sequence
  Description of Artificial Sequence: Synthetic peptide
SHAMS

SEQ ID NO: 7829 - DNA, 15 bp, Artificial Sequence
  Description of Artificial Sequence: Synthetic oligonucleotide
agctatgccatgagc

SEQ ID NO: 7830 - protein, 5 aa, Artificial Sequence
  Description of Artificial Sequence: Synthetic peptide
SYAMS

SEQ ID NO: 7831 - DNA, 15 bp, Artificial Sequence
  Description of Artificial Sequence: Synthetic oligonucleotide
agctatgccatgaac

SEQ ID NO: 7832 - protein, 5 aa, Artificial Sequence
  Description of Artificial Sequence: Synthetic peptide
SYAMN

SEQ ID NO: 7833 - DNA, 15 bp, Artificial Sequence
  Description of Artificial Sequence: Synthetic oligonucleotide
agccatgccatgagc

SEQ ID NO: 7834 - protein, 5 aa, Artificial Sequence
  Description of Artificial Sequence: Synthetic peptide
SHAMS

SEQ ID NO: 7835 - DNA, 15 bp, Artificial Sequence
  Description of Artificial Sequence: Synthetic oligonucleotide
agctatgccatgagc

SEQ ID NO: 7836 - protein, 5 aa, Artificial Sequence
  Description of Artificial Sequence: Synthetic peptide
SYAMS

SEQ ID NO: 7837 - DNA, 15 bp, Artificial Sequence
  Description of Artificial Sequence: Synthetic oligonucleotide
agctatgccatgagc

SEQ ID NO: 7838 - protein, 5 aa, Artificial Sequence
  Description of Artificial Sequence: Synthetic peptide
SYAMS

SEQ ID NO: 7839 - DNA, 15 bp, Artificial Sequence
  Description of Artificial Sequence: Synthetic oligonucleotide
agctatgccatgacc

SEQ ID NO: 7840 - protein, 5 aa, Artificial Sequence
  Description of Artificial Sequence: Synthetic peptide
SYAMT

SEQ ID NO: 7841 - DNA, 15 bp, Artificial Sequence
  Description of Artificial Sequence: Synthetic oligonucleotide
agccatgccatgagc

SEQ ID NO: 7842 - protein, 5 aa, Artificial Sequence
  Description of Artificial Sequence: Synthetic peptide
SHAMS

SEQ ID NO: 7843 - DNA, 21 bp, Artificial Sequence
  Description of Artificial Sequence: Synthetic oligonucleotide
agtagtcgttactactggggc

SEQ ID NO: 7844 - protein, 7 aa, Artificial Sequence
  Description of Artificial Sequence: Synthetic peptide
SSRYYWG

SEQ ID NO: 7845 - DNA, 21 bp, Artificial Sequence
  Description of Artificial Sequence: Synthetic oligonucleotide
agtagtcgttactactggggc

SEQ ID NO: 7846 - protein, 7 aa, Artificial Sequence
  Description of Artificial Sequence: Synthetic peptide
SSRYYWG

SEQ ID NO: 7847 - DNA, 21 bp, Artificial Sequence
  Description of Artificial Sequence: Synthetic oligonucleotide
actcataaaatgggtgtggac

SEQ ID NO: 7848 - protein, 7 aa, Artificial Sequence
  Description of Artificial Sequence: Synthetic peptide
THKMGVD

SEQ ID NO: 7849 - DNA, 21 bp, Artificial Sequence
  Description of Artificial Sequence: Synthetic oligonucleotide
actcataaaatgggtgtggac

SEQ ID NO: 7850 - protein, 7 aa, Artificial Sequence
  Description of Artificial Sequence: Synthetic peptide
THKMGVD

SEQ ID NO: 7851 - DNA, 21 bp, Artificial Sequence
  Description of Artificial Sequence: Synthetic oligonucleotide
actcataaaatgggtgtggac

SEQ ID NO: 7852 - protein, 7 aa, Artificial Sequence
  Description of Artificial Sequence: Synthetic peptide
THKMGVD

SEQ ID NO: 7853 - DNA, 21 bp, Artificial Sequence
  Description of Artificial Sequence: Synthetic oligonucleotide
actcataaaatgggtgtggac

SEQ ID NO: 7854 - protein, 7 aa, Artificial Sequence
  Description of Artificial Sequence: Synthetic peptide
THKMGVD

SEQ ID NO: 7855 - DNA, 21 bp, Artificial Sequence
  Description of Artificial Sequence: Synthetic oligonucleotide
actcataaaatgggtgtggac

SEQ ID NO: 7856 - protein, 7 aa, Artificial Sequence
  Description of Artificial Sequence: Synthetic peptide
THKMGVD

SEQ ID NO: 7857 - DNA, 21 bp, Artificial Sequence
  Description of Artificial Sequence: Synthetic oligonucleotide
actcataaaatgggtgtggac

SEQ ID NO: 7858 - protein, 7 aa, Artificial Sequence
  Description of Artificial Sequence: Synthetic peptide
THKMGVD

SEQ ID NO: 7859 - DNA, 15 bp, Artificial Sequence
  Description of Artificial Sequence: Synthetic oligonucleotide
tcctatgccatgagc

SEQ ID NO: 7860 - protein, 5 aa, Artificial Sequence
  Description of Artificial Sequence: Synthetic peptide
SYAMS

SEQ ID NO: 7861 - DNA, 15 bp, Artificial Sequence
  Description of Artificial Sequence: Synthetic oligonucleotide
aacgcctggatgagc

SEQ ID NO: 7862 - protein, 5 aa, Artificial Sequence
  Description of Artificial Sequence: Synthetic peptide
NAWMS

SEQ ID NO: 7863 - DNA, 15 bp, Artificial Sequence
  Description of Artificial Sequence: Synthetic oligonucleotide
aacgcctggatgagc

SEQ ID NO: 7864 - protein, 5 aa, Artificial Sequence
  Description of Artificial Sequence: Synthetic peptide
NAWMS

SEQ ID NO: 7865 - DNA, 15 bp, Artificial Sequence
  Description of Artificial Sequence: Synthetic oligonucleotide
aacgcctggatgagc

SEQ ID NO: 7866 - protein, 5 aa, Artificial Sequence
  Description of Artificial Sequence: Synthetic peptide
NAWMS

SEQ ID NO: 7867 - DNA, 15 bp, Artificial Sequence
  Description of Artificial Sequence: Synthetic oligonucleotide
aacgcctggatgagc

SEQ ID NO: 7868 - protein, 5 aa, Artificial Sequence
  Description of Artificial Sequence: Synthetic peptide
NAWMS

SEQ ID NO: 7869 - DNA, 15 bp, Artificial Sequence
  Description of Artificial Sequence: Synthetic oligonucleotide
aacgcctggatgagc

SEQ ID NO: 7870 - protein, 5 aa, Artificial Sequence
  Description of Artificial Sequence: Synthetic peptide
NAWMS

SEQ ID NO: 7871 - DNA, 15 bp, Artificial Sequence
  Description of Artificial Sequence: Synthetic oligonucleotide
aacgcctggatgagc

SEQ ID NO: 7872 - protein, 5 aa, Artificial Sequence
  Description of Artificial Sequence: Synthetic peptide
NAWMS

SEQ ID NO: 7873 - DNA, 21 bp, Artificial Sequence
  Description of Artificial Sequence: Synthetic oligonucleotide
agtaatccttactactggagc

SEQ ID NO: 7874 - protein, 7 aa, Artificial Sequence
  Description of Artificial Sequence: Synthetic peptide
SNPYYWS

SEQ ID NO: 7875 - DNA, 21 bp, Artificial Sequence
  Description of Artificial Sequence: Synthetic oligonucleotide
agtaatccttactactggagc

SEQ ID NO: 7876 - protein, 7 aa, Artificial Sequence
  Description of Artificial Sequence: Synthetic peptide
SNPYYWS

SEQ ID NO: 7877 - DNA, 15 bp, Artificial Sequence
  Description of Artificial Sequence: Synthetic oligonucleotide
aacgcctggatgagc

SEQ ID NO: 7878 - protein, 5 aa, Artificial Sequence
  Description of Artificial Sequence: Synthetic peptide
NAWMS

SEQ ID NO: 7879 - DNA, 15 bp, Artificial Sequence
  Description of Artificial Sequence: Synthetic oligonucleotide
aacgcctggatgagc

SEQ ID NO: 7880 - protein, 5 aa, Artificial Sequence
  Description of Artificial Sequence: Synthetic peptide
NAWMS

SEQ ID NO: 7881 - DNA, 15 bp, Artificial Sequence
  Description of Artificial Sequence: Synthetic oligonucleotide
aacgcctggatgagc

SEQ ID NO: 7882 - protein, 5 aa, Artificial Sequence
  Description of Artificial Sequence: Synthetic peptide
NAWMS

SEQ ID NO: 7883 - DNA, 21 bp, Artificial Sequence
  Description of Artificial Sequence: Synthetic oligonucleotide
agtaatccttactactggagc

SEQ ID NO: 7884 - protein, 7 aa, Artificial Sequence
  Description of Artificial Sequence: Synthetic peptide
SNPYYWS

SEQ ID NO: 7885 - DNA, 21 bp, Artificial Sequence
  Description of Artificial Sequence: Synthetic oligonucleotide
agtaatccttactactggagc

SEQ ID NO: 7886 - protein, 7 aa, Artificial Sequence
  Description of Artificial Sequence: Synthetic peptide
SNPYYWS

SEQ ID NO: 7887 - DNA, 21 bp, Artificial Sequence
  Description of Artificial Sequence: Synthetic oligonucleotide
agtggtggttactactggagc

SEQ ID NO: 7888 - protein, 7 aa, Artificial Sequence
  Description of Artificial Sequence: Synthetic peptide
SGGYYWS

SEQ ID NO: 7889 - DNA, 15 bp, Artificial Sequence
  Description of Artificial Sequence: Synthetic oligonucleotide
aacgcctggatgagc

SEQ ID NO: 7890 - protein, 5 aa, Artificial Sequence
  Description of Artificial Sequence: Synthetic peptide
NAWMS

SEQ ID NO: 7891 - protein, 5 aa, Artificial Sequence
  Description of Artificial Sequence: Synthetic peptide
SYAMS

SEQ ID NO: 7892 - protein, 5 aa, Artificial Sequence
  Description of Artificial Sequence: Synthetic peptide
SYAMS

SEQ ID NO: 7893 - protein, 5 aa, Artificial Sequence
  Description of Artificial Sequence: Synthetic peptide
TYGMH

SEQ ID NO: 7894 - protein, 5 aa, Artificial Sequence
  Description of Artificial Sequence: Synthetic peptide
DYYMS

SEQ ID NO: 7895 - protein, 7 aa, Artificial Sequence
  Description of Artificial Sequence: Synthetic peptide
SNPYYWS

SEQ ID NO: 7896 - protein, 7 aa, Artificial Sequence
  Description of Artificial Sequence: Synthetic peptide
SSRYYWG

SEQ ID NO: 7897 - protein, 5 aa, Artificial Sequence
  Description of Artificial Sequence: Synthetic peptide
SHAMS

SEQ ID NO: 7898 - protein, 5 aa, Artificial Sequence
  Description of Artificial Sequence: Synthetic peptide
SHAMS

SEQ ID NO: 7899 - protein, 5 aa, Artificial Sequence
  Description of Artificial Sequence: Synthetic peptide
SHAMS

SEQ ID NO: 7900 - protein, 5 aa, Artificial Sequence
  Description of Artificial Sequence: Synthetic peptide
SHAMS

SEQ ID NO: 7901 - protein, 5 aa, Artificial Sequence
  Description of Artificial Sequence: Synthetic peptide
SYAMS

SEQ ID NO: 7902 - protein, 5 aa, Artificial Sequence
  Description of Artificial Sequence: Synthetic peptide
SYAMS

SEQ ID NO: 7903 - protein, 5 aa, Artificial Sequence
  Description of Artificial Sequence: Synthetic peptide
SYAMS

SEQ ID NO: 7904 - protein, 5 aa, Artificial Sequence
  Description of Artificial Sequence: Synthetic peptide
SYAMS

SEQ ID NO: 7905 - protein, 5 aa, Artificial Sequence
  Description of Artificial Sequence: Synthetic peptide
NAWMS

SEQ ID NO: 7906 - protein, 7 aa, Artificial Sequence
  Description of Artificial Sequence: Synthetic peptide
THKMGVD

SEQ ID NO: 7907 - protein, 7 aa, Artificial Sequence
  Description of Artificial Sequence: Synthetic peptide
THKMGVD

SEQ ID NO: 7908 - protein, 7 aa, Artificial Sequence
  Description of Artificial Sequence: Synthetic peptide
THKMGVD

SEQ ID NO: 7909 - protein, 7 aa, Artificial Sequence
  Description of Artificial Sequence: Synthetic peptide
THKMGVD

SEQ ID NO: 7910 - protein, 5 aa, Artificial Sequence
  Description of Artificial Sequence: Synthetic peptide
NAWMS

SEQ ID NO: 7911 - protein, 5 aa, Artificial Sequence
  Description of Artificial Sequence: Synthetic peptide
NAWMS

SEQ ID NO: 7912 - protein, 5 aa, Artificial Sequence
  Description of Artificial Sequence: Synthetic peptide
NAWMS

SEQ ID NO: 7913 - protein, 5 aa, Artificial Sequence
  Description of Artificial Sequence: Synthetic peptide
NAWMS

SEQ ID NO: 7914 - protein, 5 aa, Artificial Sequence
  Description of Artificial Sequence: Synthetic peptide
SHAMS

SEQ ID NO: 7915 - protein, 5 aa, Artificial Sequence
  Description of Artificial Sequence: Synthetic peptide
SHAMS

SEQ ID NO: 7916 - protein, 5 aa, Artificial Sequence
  Description of Artificial Sequence: Synthetic peptide
NAWMS

SEQ ID NO: 7917 - protein, 5 aa, Artificial Sequence
  Description of Artificial Sequence: Synthetic peptide
NAWMS

SEQ ID NO: 7918 - protein, 5 aa, Artificial Sequence
  Description of Artificial Sequence: Synthetic peptide
TYGMH

SEQ ID NO: 7919 - DNA, 21 bp, Artificial Sequence
  Description of Artificial Sequence: Synthetic oligonucleotide
tgggcatccactagggaatct

SEQ ID NO: 7920 - protein, 7 aa, Artificial Sequence
  Description of Artificial Sequence: Synthetic peptide
WASTRES

SEQ ID NO: 7921 - DNA, 21 bp, Artificial Sequence
  Description of Artificial Sequence: Synthetic oligonucleotide
gacacatccaaactggctcct

SEQ ID NO: 7922 - protein, 7 aa, Artificial Sequence
  Description of Artificial Sequence: Synthetic peptide
DTSKLAP

SEQ ID NO: 7923 - DNA, 21 bp, Artificial Sequence
  Description of Artificial Sequence: Synthetic oligonucleotide
aatgcaaaaaccttagcagga

SEQ ID NO: 7924 - protein, 7 aa, Artificial Sequence
  Description of Artificial Sequence: Synthetic peptide
NAKTLAG

SEQ ID NO: 7925 - DNA, 21 bp, Artificial Sequence
  Description of Artificial Sequence: Synthetic oligonucleotide
ttgggttctaatcgggcctcc

SEQ ID NO: 7926 - protein, 7 aa, Artificial Sequence
  Description of Artificial Sequence: Synthetic peptide
LGSNRAS

SEQ ID NO: 7927 - DNA, 21 bp, Artificial Sequence
  Description of Artificial Sequence: Synthetic oligonucleotide
ttgggttctatccgggcctcc

SEQ ID NO: 7928 - protein, 7 aa, Artificial Sequence
  Description of Artificial Sequence: Synthetic peptide
LGSIRAS

SEQ ID NO: 7929 - DNA, 21 bp, Artificial Sequence
  Description of Artificial Sequence: Synthetic oligonucleotide
ttgggttctaagcgggcctcc

SEQ ID NO: 7930 - protein, 7 aa, Artificial Sequence
  Description of Artificial Sequence: Synthetic peptide
LGSKRAS

SEQ ID NO: 7931 - DNA, 21 bp, Artificial Sequence
  Description of Artificial Sequence: Synthetic oligonucleotide
ggtgcatccagcagggccact

SEQ ID NO: 7932 - protein, 7 aa, Artificial Sequence
  Description of Artificial Sequence: Synthetic peptide
GASSRAT

SEQ ID NO: 7933 - DNA, 21 bp, Artificial Sequence
  Description of Artificial Sequence: Synthetic oligonucleotide
ggtgcatccagcagggccact

SEQ ID NO: 7934 - protein, 7 aa, Artificial Sequence
  Description of Artificial Sequence: Synthetic peptide
GASSRAT

SEQ ID NO: 7935 - DNA, 21 bp, Artificial Sequence
  Description of Artificial Sequence: Synthetic oligonucleotide
ttgggttctaatcgggcctcc

SEQ ID NO: 7936 - protein, 7 aa, Artificial Sequence
  Description of Artificial Sequence: Synthetic peptide
LGSNRAS

SEQ ID NO: 7937 - DNA, 21 bp, Artificial Sequence
  Description of Artificial Sequence: Synthetic oligonucleotide
gctgcatccagtttgcaaagt

SEQ ID NO: 7938 - protein, 7 aa, Artificial Sequence
  Description of Artificial Sequence: Synthetic peptide
AASSLQS

SEQ ID NO: 7939 - DNA, 21 bp, Artificial Sequence
  Description of Artificial Sequence: Synthetic oligonucleotide
ttgggttctaatcgggcctcc

SEQ ID NO: 7940 - protein, 7 aa, Artificial Sequence
  Description of Artificial Sequence: Synthetic peptide
LGSNRAS

SEQ ID NO: 7941 - DNA, 21 bp, Artificial Sequence
  Description of Artificial Sequence: Synthetic oligonucleotide
ggtgcatccagcagggccact

SEQ ID NO: 7942 - protein, 7 aa, Artificial Sequence
  Description of Artificial Sequence: Synthetic peptide
GASSRAT

SEQ ID NO: 7943 - DNA, 21 bp, Artificial Sequence
  Description of Artificial Sequence: Synthetic oligonucleotide
ttgggttctaatcgggcctcc

SEQ ID NO: 7944 - protein, 7 aa, Artificial Sequence
  Description of Artificial Sequence: Synthetic peptide
LGSNRAS

SEQ ID NO: 7945 - DNA, 21 bp, Artificial Sequence
  Description of Artificial Sequence: Synthetic oligonucleotide
ttgggttctaatcgggcctcc

SEQ ID NO: 7946 - protein, 7 aa, Artificial Sequence
  Description of Artificial Sequence: Synthetic peptide
LGSNRAS

SEQ ID NO: 7947 - DNA, 21 bp, Artificial Sequence
  Description of Artificial Sequence: Synthetic oligonucleotide
ttgggttctaatcgggcctcc

SEQ ID NO: 7948 - protein, 7 aa, Artificial Sequence
  Description of Artificial Sequence: Synthetic peptide
LGSNRAS

SEQ ID NO: 7949 - DNA, 21 bp, Artificial Sequence
  Description of Artificial Sequence: Synthetic oligonucleotide
ttgggttctaatcgggcctcc

SEQ ID NO: 7950 - protein, 7 aa, Artificial Sequence
  Description of Artificial Sequence: Synthetic peptide
LGSNRAS

SEQ ID NO: 7951 - DNA, 21 bp, Artificial Sequence
  Description of Artificial Sequence: Synthetic oligonucleotide
gatgcatccagtttgcaaagt

SEQ ID NO: 7952 - protein, 7 aa, Artificial Sequence
  Description of Artificial Sequence: Synthetic peptide
DASSLQS

SEQ ID NO: 7953 - DNA, 21 bp, Artificial Sequence
  Description of Artificial Sequence: Synthetic oligonucleotide
ttgggttctaatcgggcctcc

SEQ ID NO: 7954 - protein, 7 aa, Artificial Sequence
  Description of Artificial Sequence: Synthetic peptide
LGSNRAS

SEQ ID NO: 7955 - DNA, 21 bp, Artificial Sequence
  Description of Artificial Sequence: Synthetic oligonucleotide
ttgggttctaatcgggcctcc

SEQ ID NO: 7956 - protein, 7 aa, Artificial Sequence
  Description of Artificial Sequence: Synthetic peptide
LGSNRAS

SEQ ID NO: 7957 - DNA, 21 bp, Artificial Sequence
  Description of Artificial Sequence: Synthetic oligonucleotide
ttgggttctaatcgggcctcc

SEQ ID NO: 7958 - protein, 7 aa, Artificial Sequence
  Description of Artificial Sequence: Synthetic peptide
LGSNRAS

SEQ ID NO: 7959 - DNA, 21 bp, Artificial Sequence
  Description of Artificial Sequence: Synthetic oligonucleotide
ttgggttctaatcgggcctcc

SEQ ID NO: 7960 - protein, 7 aa, Artificial Sequence
  Description of Artificial Sequence: Synthetic peptide
LGSNRAS

SEQ ID NO: 7961 - DNA, 21 bp, Artificial Sequence
  Description of Artificial Sequence: Synthetic oligonucleotide
ttgggttctaatcgggcctcc

SEQ ID NO: 7962 - protein, 7 aa, Artificial Sequence
  Description of Artificial Sequence: Synthetic peptide
LGSNRAS

SEQ ID NO: 7963 - DNA, 21 bp, Artificial Sequence
  Description of Artificial Sequence: Synthetic oligonucleotide
ttgggttcttatcgggcctcc

SEQ ID NO: 7964 - protein, 7 aa, Artificial Sequence
  Description of Artificial Sequence: Synthetic peptide
LGSYRAS

SEQ ID NO: 7965 - DNA, 21 bp, Artificial Sequence
  Description of Artificial Sequence: Synthetic oligonucleotide
ttggtctctaagcgggcctcc

SEQ ID NO: 7966 - protein, 7 aa, Artificial Sequence
  Description of Artificial Sequence: Synthetic peptide
LVSKRAS

SEQ ID NO: 7967 - DNA, 21 bp, Artificial Sequence
  Description of Artificial Sequence: Synthetic oligonucleotide
gctgcatccagtttgcaaagt

SEQ ID NO: 7968 - protein, 7 aa, Artificial Sequence
  Description of Artificial Sequence: Synthetic peptide
AASSLQS

SEQ ID NO: 7969 - DNA, 21 bp, Artificial Sequence
  Description of Artificial Sequence: Synthetic oligonucleotide
gctgcatccagtttgcaaagt

SEQ ID NO: 7970 - protein, 7 aa, Artificial Sequence
  Description of Artificial Sequence: Synthetic peptide
AASSLQS

SEQ ID NO: 7971 - DNA, 21 bp, Artificial Sequence
  Description of Artificial Sequence: Synthetic oligonucleotide
ttgggttctaatcgggcctcc

SEQ ID NO: 7972 - protein, 7 aa, Artificial Sequence
  Description of Artificial Sequence: Synthetic peptide
LGSNRAS

SEQ ID NO: 7973 - DNA, 21 bp, Artificial Sequence
  Description of Artificial Sequence: Synthetic oligonucleotide
ttgggttctaatcgggcctcc

SEQ ID NO: 7974 - protein, 7 aa, Artificial Sequence
  Description of Artificial Sequence: Synthetic peptide
LGSNRAS

SEQ ID NO: 7975 - DNA, 21 bp, Artificial Sequence
  Description of Artificial Sequence: Synthetic oligonucleotide
ttgggttctaatcgggcctcc

SEQ ID NO: 7976 - protein, 7 aa, Artificial Sequence
  Description of Artificial Sequence: Synthetic peptide
LGSNRAS

SEQ ID NO: 7977 - DNA, 21 bp, Artificial Sequence
  Description of Artificial Sequence: Synthetic oligonucleotide
ttgggttctaatcgggcctcc

SEQ ID NO: 7978 - protein, 7 aa, Artificial Sequence
  Description of Artificial Sequence: Synthetic peptide
LGSNRAS

SEQ ID NO: 7979 - DNA, 21 bp, Artificial Sequence
  Description of Artificial Sequence: Synthetic oligonucleotide
gctgcatccactttgcaatca

SEQ ID NO: 7980 - protein, 7 aa, Artificial Sequence
  Description of Artificial Sequence: Synthetic peptide
AASTLQS

SEQ ID NO: 7981 - DNA, 21 bp, Artificial Sequence
  Description of Artificial Sequence: Synthetic oligonucleotide
ttgggttctaatcgggcctcc

SEQ ID NO: 7982 - protein, 7 aa, Artificial Sequence
  Description of Artificial Sequence: Synthetic peptide
LGSNRAS

SEQ ID NO: 7983 - DNA, 21 bp, Artificial Sequence
  Description of Artificial Sequence: Synthetic oligonucleotide
ttgggttctaagcgggcctcc

SEQ ID NO: 7984 - protein, 7 aa, Artificial Sequence
  Description of Artificial Sequence: Synthetic peptide
LGSKRAS

SEQ ID NO: 7985 - DNA, 21 bp, Artificial Sequence
  Description of Artificial Sequence: Synthetic oligonucleotide
ttgggttctaatcgggcctcc

SEQ ID NO: 7986 - protein, 7 aa, Artificial Sequence
  Description of Artificial Sequence: Synthetic peptide
LGSNRAS

SEQ ID NO: 7987 - DNA, 21 bp, Artificial Sequence
  Description of Artificial Sequence: Synthetic oligonucleotide
ttgggttctaatcgggcctcc

SEQ ID NO: 7988 - protein, 7 aa, Artificial Sequence
  Description of Artificial Sequence: Synthetic peptide
LGSNRAS

SEQ ID NO: 7989 - DNA, 21 bp, Artificial Sequence
  Description of Artificial Sequence: Synthetic oligonucleotide
gaggtcagtaagcggccctca

SEQ ID NO: 7990 - protein, 7 aa, Artificial Sequence
  Description of Artificial Sequence: Synthetic peptide
EVSKRPS

SEQ ID NO: 7991 - DNA, 21 bp, Artificial Sequence
  Description of Artificial Sequence: Synthetic oligonucleotide
tgggcatctacccgggaatcc

SEQ ID NO: 7992 - protein, 7 aa, Artificial Sequence
  Description of Artificial Sequence: Synthetic peptide
WASTRES

SEQ ID NO: 7993 - DNA, 21 bp, Artificial Sequence
  Description of Artificial Sequence: Synthetic oligonucleotide
tgggcatctacccgggaatcc

SEQ ID NO: 7994 - protein, 7 aa, Artificial Sequence
  Description of Artificial Sequence: Synthetic peptide
WASTRES

SEQ ID NO: 7995 - DNA, 21 bp, Artificial Sequence
  Description of Artificial Sequence: Synthetic oligonucleotide
ggtgcatccgccagggccact

SEQ ID NO: 7996 - protein, 7 aa, Artificial Sequence
  Description of Artificial Sequence: Synthetic peptide
GASARAT

SEQ ID NO: 7997 - DNA, 21 bp, Artificial Sequence
  Description of Artificial Sequence: Synthetic oligonucleotide
aggaataatcagcggccctca

SEQ ID NO: 7998 - protein, 7 aa, Artificial Sequence
  Description of Artificial Sequence: Synthetic peptide
RNNQRPS

SEQ ID NO: 7999 - DNA, 21 bp, Artificial Sequence
  Description of Artificial Sequence: Synthetic oligonucleotide
gatgcatccaatttggaaaca

SEQ ID NO: 8000 - protein, 7 aa, Artificial Sequence
  Description of Artificial Sequence: Synthetic peptide
DASNLET

SEQ ID NO: 8001 - DNA, 21 bp, Artificial Sequence
  Description of Artificial Sequence: Synthetic oligonucleotide
aggaataacaaccggccctca

SEQ ID NO: 8002 - protein, 7 aa, Artificial Sequence
  Description of Artificial Sequence: Synthetic peptide
RNNNRPS

SEQ ID NO: 8003 - DNA, 21 bp, Artificial Sequence
  Description of Artificial Sequence: Synthetic oligonucleotide
aggaataacaaccggccctca

SEQ ID NO: 8004 - protein, 7 aa, Artificial Sequence
  Description of Artificial Sequence: Synthetic peptide
RNNNRPS

SEQ ID NO: 8005 - DNA, 21 bp, Artificial Sequence
  Description of Artificial Sequence: Synthetic oligonucleotide
tgggcatctacccgggaatcc

SEQ ID NO: 8006 - protein, 7 aa, Artificial Sequence
  Description of Artificial Sequence: Synthetic peptide
WASTRES

SEQ ID NO: 8007 - DNA, 21 bp, Artificial Sequence
  Description of Artificial Sequence: Synthetic oligonucleotide
tgggcatctacccgggaatcc

SEQ ID NO: 8008 - protein, 7 aa, Artificial Sequence
  Description of Artificial Sequence: Synthetic peptide
WASTRES

SEQ ID NO: 8009 - DNA, 21 bp, Artificial Sequence
  Description of Artificial Sequence: Synthetic oligonucleotide
ttgggttctaatcgggcctcc

SEQ ID NO: 8010 - protein, 7 aa, Artificial Sequence
  Description of Artificial Sequence: Synthetic peptide
LGSNRAS

SEQ ID NO: 8011 - DNA, 21 bp, Artificial Sequence
  Description of Artificial Sequence: Synthetic oligonucleotide
ggtgcatccagcagggccact

SEQ ID NO: 8012 - protein, 7 aa, Artificial Sequence
  Description of Artificial Sequence: Synthetic peptide
GASSRAT

SEQ ID NO: 8013 - DNA, 21 bp, Artificial Sequence
  Description of Artificial Sequence: Synthetic oligonucleotide
tgggcatctacccgggaatcc

SEQ ID NO: 8014 - protein, 7 aa, Artificial Sequence
  Description of Artificial Sequence: Synthetic peptide
WASTRES

SEQ ID NO: 8015 - DNA, 21 bp, Artificial Sequence
  Description of Artificial Sequence: Synthetic oligonucleotide
ttgggttctaatcgggcctcc

SEQ ID NO: 8016 - protein, 7 aa, Artificial Sequence
  Description of Artificial Sequence: Synthetic peptide
LGSNRAS

SEQ ID NO: 8017 - DNA, 21 bp, Artificial Sequence
  Description of Artificial Sequence: Synthetic oligonucleotide
tgggcatctacccgggaatcc

SEQ ID NO: 8018 - protein, 7 aa, Artificial Sequence
  Description of Artificial Sequence: Synthetic peptide
WASTRES

SEQ ID NO: 8019 - DNA, 21 bp, Artificial Sequence
  Description of Artificial Sequence: Synthetic oligonucleotide
gctgcatccagtttgcaaagt

SEQ ID NO: 8020 - protein, 7 aa, Artificial Sequence
  Description of Artificial Sequence: Synthetic peptide
AASSLQS

SEQ ID NO: 8021 - DNA, 21 bp, Artificial Sequence
  Description of Artificial Sequence: Synthetic oligonucleotide
gctacatccagtttgcaaagt

SEQ ID NO: 8022 - protein, 7 aa, Artificial Sequence
  Description of Artificial Sequence: Synthetic peptide
ATSSLQS

SEQ ID NO: 8023 - DNA, 21 bp, Artificial Sequence
  Description of Artificial Sequence: Synthetic oligonucleotide
gaggtcagtaagcggccctca

SEQ ID NO: 8024 - protein, 7 aa, Artificial Sequence
  Description of Artificial Sequence: Synthetic peptide
EVSKRPS

SEQ ID NO: 8025 - DNA, 21 bp, Artificial Sequence
  Description of Artificial Sequence: Synthetic oligonucleotide
ggtgcatccagcagggccact

SEQ ID NO: 8026 - protein, 7 aa, Artificial Sequence
  Description of Artificial Sequence: Synthetic peptide
GASSRAT

SEQ ID NO: 8027 - DNA, 21 bp, Artificial Sequence
  Description of Artificial Sequence: Synthetic oligonucleotide
tgggcatctacccgggaatcc

SEQ ID NO: 8028 - protein, 7 aa, Artificial Sequence
  Description of Artificial Sequence: Synthetic peptide
WASTRES

SEQ ID NO: 8029 - DNA, 21 bp, Artificial Sequence
  Description of Artificial Sequence: Synthetic oligonucleotide
ggtgcatccaccagggccact

SEQ ID NO: 8030 - protein, 7 aa, Artificial Sequence
  Description of Artificial Sequence: Synthetic peptide
GASTRAT

SEQ ID NO: 8031 - DNA, 21 bp, Artificial Sequence
  Description of Artificial Sequence: Synthetic oligonucleotide
ttgggttctaagcgggcctcc

SEQ ID NO: 8032 - protein, 7 aa, Artificial Sequence
  Description of Artificial Sequence: Synthetic peptide
LGSKRAS

SEQ ID NO: 8033 - DNA, 21 bp, Artificial Sequence
  Description of Artificial Sequence: Synthetic oligonucleotide
tgggcatctacccgggaatcc

SEQ ID NO: 8034 - protein, 7 aa, Artificial Sequence
  Description of Artificial Sequence: Synthetic peptide
WASTRES

SEQ ID NO: 8035 - DNA, 21 bp, Artificial Sequence
  Description of Artificial Sequence: Synthetic oligonucleotide
gctgcatccagtttgcaaagt

SEQ ID NO: 8036 - protein, 7 aa, Artificial Sequence
  Description of Artificial Sequence: Synthetic peptide
AASSLQS

SEQ ID NO: 8037 - DNA, 21 bp, Artificial Sequence
  Description of Artificial Sequence: Synthetic oligonucleotide
gctacatccagtttgcaaagt

SEQ ID NO: 8038 - protein, 7 aa, Artificial Sequence
  Description of Artificial Sequence: Synthetic peptide
ATSSLQS

SEQ ID NO: 8039 - DNA, 21 bp, Artificial Sequence
  Description of Artificial Sequence: Synthetic oligonucleotide
gctgcatccagtttgcaaagt

SEQ ID NO: 8040 - protein, 7 aa, Artificial Sequence
  Description of Artificial Sequence: Synthetic peptide
AASSLQS

SEQ ID NO: 8041 - DNA, 21 bp, Artificial Sequence
  Description of Artificial Sequence: Synthetic oligonucleotide
ggtgcatccactttgcaatta

SEQ ID NO: 8042 - protein, 7 aa, Artificial Sequence
  Description of Artificial Sequence: Synthetic peptide
GASTLQL

SEQ ID NO: 8043 - DNA, 21 bp, Artificial Sequence
  Description of Artificial Sequence: Synthetic oligonucleotide
gctgcatccagtttgcaaagt

SEQ ID NO: 8044 - protein, 7 aa, Artificial Sequence
  Description of Artificial Sequence: Synthetic peptide
AASSLQS

SEQ ID NO: 8045 - DNA, 21 bp, Artificial Sequence
  Description of Artificial Sequence: Synthetic oligonucleotide
aggaataacaaccggccctca

SEQ ID NO: 8046 - protein, 7 aa, Artificial Sequence
  Description of Artificial Sequence: Synthetic peptide
RNNNRPS

SEQ ID NO: 8047 - DNA, 21 bp, Artificial Sequence
  Description of Artificial Sequence: Synthetic oligonucleotide
gctgcatccagtttgcaaagt

SEQ ID NO: 8048 - protein, 7 aa, Artificial Sequence
  Description of Artificial Sequence: Synthetic peptide
AASSLQS

SEQ ID NO: 8049 - DNA, 21 bp, Artificial Sequence
  Description of Artificial Sequence: Synthetic oligonucleotide
gctgcatccagtttgcaaagt

SEQ ID NO: 8050 - protein, 7 aa, Artificial Sequence
  Description of Artificial Sequence: Synthetic peptide
AASSLQS

SEQ ID NO: 8051 - DNA, 21 bp, Artificial Sequence
  Description of Artificial Sequence: Synthetic oligonucleotide
ttgggttctaatcgggcctcc

SEQ ID NO: 8052 - protein, 7 aa, Artificial Sequence
  Description of Artificial Sequence: Synthetic peptide
LGSNRAS

SEQ ID NO: 8053 - DNA, 21 bp, Artificial Sequence
  Description of Artificial Sequence: Synthetic oligonucleotide
ttgggttctaatcgggcctcc

SEQ ID NO: 8054 - protein, 7 aa, Artificial Sequence
  Description of Artificial Sequence: Synthetic peptide
LGSNRAS

SEQ ID NO: 8055 - DNA, 21 bp, Artificial Sequence
  Description of Artificial Sequence: Synthetic oligonucleotide
ttgggttctaatcgggcctcc

SEQ ID NO: 8056 - protein, 7 aa, Artificial Sequence
  Description of Artificial Sequence: Synthetic peptide
LGSNRAS

SEQ ID NO: 8057 - DNA, 21 bp, Artificial Sequence
  Description of Artificial Sequence: Synthetic oligonucleotide
ttgggttctaatcgggcctcc

SEQ ID NO: 8058 - protein, 7 aa, Artificial Sequence
  Description of Artificial Sequence: Synthetic peptide
LGSNRAS

SEQ ID NO: 8059 - DNA, 21 bp, Artificial Sequence
  Description of Artificial Sequence: Synthetic oligonucleotide
gctgcatccagtttgcaaggt

SEQ ID NO: 8060 - protein, 7 aa, Artificial Sequence
  Description of Artificial Sequence: Synthetic peptide
AASSLQG

SEQ ID NO: 8061 - DNA, 21 bp, Artificial Sequence
  Description of Artificial Sequence: Synthetic oligonucleotide
gctgcatccagtttgcaaagt

SEQ ID NO: 8062 - protein, 7 aa, Artificial Sequence
  Description of Artificial Sequence: Synthetic peptide
AASSLQS

SEQ ID NO: 8063 - DNA, 21 bp, Artificial Sequence
  Description of Artificial Sequence: Synthetic oligonucleotide
ttgggttctaatcgggcctcc

SEQ ID NO: 8064 - protein, 7 aa, Artificial Sequence
  Description of Artificial Sequence: Synthetic peptide
LGSNRAS

SEQ ID NO: 8065 - DNA, 21 bp, Artificial Sequence
  Description of Artificial Sequence: Synthetic oligonucleotide
ttgggttctaatcgggcctcc

SEQ ID NO: 8066 - protein, 7 aa, Artificial Sequence
  Description of Artificial Sequence: Synthetic peptide
LGSNRAS

SEQ ID NO: 8067 - DNA, 21 bp, Artificial Sequence
  Description of Artificial Sequence: Synthetic oligonucleotide
ttgggttctaatcgggcctcc

SEQ ID NO: 8068 - protein, 7 aa, Artificial Sequence
  Description of Artificial Sequence: Synthetic peptide
LGSNRAS

SEQ ID NO: 8069 - DNA, 21 bp, Artificial Sequence
  Description of Artificial Sequence: Synthetic oligonucleotide
ttgggttctaatcgggcctcc

SEQ ID NO: 8070 - protein, 7 aa, Artificial Sequence
  Description of Artificial Sequence: Synthetic peptide
LGSNRAS

SEQ ID NO: 8071 - DNA, 21 bp, Artificial Sequence
  Description of Artificial Sequence: Synthetic oligonucleotide
gctgcatccagtttgcaaggt

SEQ ID NO: 8072 - protein, 7 aa, Artificial Sequence
  Description of Artificial Sequence: Synthetic peptide
AASSLQG

SEQ ID NO: 8073 - DNA, 21 bp, Artificial Sequence
  Description of Artificial Sequence: Synthetic oligonucleotide
gctgcatccagtttacaaagt

SEQ ID NO: 8074 - protein, 7 aa, Artificial Sequence
  Description of Artificial Sequence: Synthetic peptide
AASSLQS

SEQ ID NO: 8075 - DNA, 21 bp, Artificial Sequence
  Description of Artificial Sequence: Synthetic oligonucleotide
gctgcatccagtttgcaaggt

SEQ ID NO: 8076 - protein, 7 aa, Artificial Sequence
  Description of Artificial Sequence: Synthetic peptide
AASSLQG

SEQ ID NO: 8077 - DNA, 21 bp, Artificial Sequence
  Description of Artificial Sequence: Synthetic oligonucleotide
ttgggttctaatcgggcctcc

SEQ ID NO: 8078 - protein, 7 aa, Artificial Sequence
  Description of Artificial Sequence: Synthetic peptide
LGSNRAS

SEQ ID NO: 8079 - DNA, 21 bp, Artificial Sequence
  Description of Artificial Sequence: Synthetic oligonucleotide
ttgggttctaatcgggcctcc

SEQ ID NO: 8080 - protein, 7 aa, Artificial Sequence
  Description of Artificial Sequence: Synthetic peptide
LGSNRAS

SEQ ID NO: 8081 - DNA, 21 bp, Artificial Sequence
  Description of Artificial Sequence: Synthetic oligonucleotide
ttgggttctaatcgggcctcc

SEQ ID NO: 8082 - protein, 7 aa, Artificial Sequence
  Description of Artificial Sequence: Synthetic peptide
LGSNRAS

SEQ ID NO: 8083 - DNA, 21 bp, Artificial Sequence
  Description of Artificial Sequence: Synthetic oligonucleotide
ttgggttctaatcgggcctcc

SEQ ID NO: 8084 - protein, 7 aa, Artificial Sequence
  Description of Artificial Sequence: Synthetic peptide
LGSNRAS

SEQ ID NO: 8085 - DNA, 21 bp, Artificial Sequence
  Description of Artificial Sequence: Synthetic oligonucleotide
ttgggttctaatcgggcctcc

SEQ ID NO: 8086 - protein, 7 aa, Artificial Sequence
  Description of Artificial Sequence: Synthetic peptide
LGSNRAS

SEQ ID NO: 8087 - DNA, 21 bp, Artificial Sequence
  Description of Artificial Sequence: Synthetic oligonucleotide
ttgggttctaatcgggcctcc

SEQ ID NO: 8088 - protein, 7 aa, Artificial Sequence
  Description of Artificial Sequence: Synthetic peptide
LGSNRAS

SEQ ID NO: 8089 - DNA, 21 bp, Artificial Sequence
  Description of Artificial Sequence: Synthetic oligonucleotide
ttgggttctaatcgggcctcc

SEQ ID NO: 8090 - protein, 7 aa, Artificial Sequence
  Description of Artificial Sequence: Synthetic peptide
LGSNRAS

SEQ ID NO: 8091 - DNA, 21 bp, Artificial Sequence
  Description of Artificial Sequence: Synthetic oligonucleotide
ttgggttctaatcgggcctcc

SEQ ID NO: 8092 - protein, 7 aa, Artificial Sequence
  Description of Artificial Sequence: Synthetic peptide
LGSNRAS

SEQ ID NO: 8093 - DNA, 21 bp, Artificial Sequence
  Description of Artificial Sequence: Synthetic oligonucleotide
ttgggttctaatcgggcctcc

SEQ ID NO: 8094 - protein, 7 aa, Artificial Sequence
  Description of Artificial Sequence: Synthetic peptide
LGSNRAS

SEQ ID NO: 8095 - DNA, 21 bp, Artificial Sequence
  Description of Artificial Sequence: Synthetic oligonucleotide
ttgggttctaatcgggcctcc

SEQ ID NO: 8096 - protein, 7 aa, Artificial Sequence
  Description of Artificial Sequence: Synthetic peptide
LGSNRAS

SEQ ID NO: 8097 - DNA, 21 bp, Artificial Sequence
  Description of Artificial Sequence: Synthetic oligonucleotide
gctgcatccagtttgcaaggt

SEQ ID NO: 8098 - protein, 7 aa, Artificial Sequence
  Description of Artificial Sequence: Synthetic peptide
AASSLQG

SEQ ID NO: 8099 - DNA, 21 bp, Artificial Sequence
  Description of Artificial Sequence: Synthetic oligonucleotide
ttgggttctaatcgggcctcc

SEQ ID NO: 8100 - protein, 7 aa, Artificial Sequence
  Description of Artificial Sequence: Synthetic peptide
LGSNRAS

SEQ ID NO: 8101 - DNA, 21 bp, Artificial Sequence
  Description of Artificial Sequence: Synthetic oligonucleotide
gatgataacgaccggccctca

SEQ ID NO: 8102 - protein, 7 aa, Artificial Sequence
  Description of Artificial Sequence: Synthetic peptide
DDNDRPS

SEQ ID NO: 8103 - DNA, 21 bp, Artificial Sequence
  Description of Artificial Sequence: Synthetic oligonucleotide
gatgataacgaccggccctca

SEQ ID NO: 8104 - protein, 7 aa, Artificial Sequence
  Description of Artificial Sequence: Synthetic peptide
DDNDRPS

SEQ ID NO: 8105 - DNA, 21 bp, Artificial Sequence
  Description of Artificial Sequence: Synthetic oligonucleotide
gatgataacgaccggccctca

SEQ ID NO: 8106 - protein, 7 aa, Artificial Sequence
  Description of Artificial Sequence: Synthetic peptide
DDNDRPS

SEQ ID NO: 8107 - DNA, 21 bp, Artificial Sequence
  Description of Artificial Sequence: Synthetic oligonucleotide
gatgataacgaccggccctca

SEQ ID NO: 8108 - protein, 7 aa, Artificial Sequence
  Description of Artificial Sequence: Synthetic peptide
DDNDRPS

SEQ ID NO: 8109 - DNA, 21 bp, Artificial Sequence
  Description of Artificial Sequence: Synthetic oligonucleotide
gatgataacgaccggccctca

SEQ ID NO: 8110 - protein, 7 aa, Artificial Sequence
  Description of Artificial Sequence: Synthetic peptide
DDNDRPS

SEQ ID NO: 8111 - DNA, 21 bp, Artificial Sequence
  Description of Artificial Sequence: Synthetic oligonucleotide
gatgataacgaccggccctca

SEQ ID NO: 8112 - protein, 7 aa, Artificial Sequence
  Description of Artificial Sequence: Synthetic peptide
DDNDRPS

SEQ ID NO: 8113 - DNA, 21 bp, Artificial Sequence
  Description of Artificial Sequence: Synthetic oligonucleotide
gatgataacgaccggccctca

SEQ ID NO: 8114 - protein, 7 aa, Artificial Sequence
  Description of Artificial Sequence: Synthetic peptide
DDNDRPS

SEQ ID NO: 8115 - DNA, 21 bp, Artificial Sequence
  Description of Artificial Sequence: Synthetic oligonucleotide
gatgataacgaccggccctca

SEQ ID NO: 8116 - protein, 7 aa, Artificial Sequence
  Description of Artificial Sequence: Synthetic peptide
DDNDRPS

SEQ ID NO: 8117 - DNA, 21 bp, Artificial Sequence
  Description of Artificial Sequence: Synthetic oligonucleotide
gatgataacgaccggccctca

SEQ ID NO: 8118 - protein, 7 aa, Artificial Sequence
  Description of Artificial Sequence: Synthetic peptide
DDNDRPS

SEQ ID NO: 8119 - DNA, 21 bp, Artificial Sequence
  Description of Artificial Sequence: Synthetic oligonucleotide
gatgataacgaccggccctca

SEQ ID NO: 8120 - protein, 7 aa, Artificial Sequence
  Description of Artificial Sequence: Synthetic peptide
DDNDRPS

SEQ ID NO: 8121 - DNA, 21 bp, Artificial Sequence
  Description of Artificial Sequence: Synthetic oligonucleotide
gatgataacgaccggccctca

SEQ ID NO: 8122 - protein, 7 aa, Artificial Sequence
  Description of Artificial Sequence: Synthetic peptide
DDNDRPS

SEQ ID NO: 8123 - DNA, 21 bp, Artificial Sequence
  Description of Artificial Sequence: Synthetic oligonucleotide
gatgataacgaccggccctca

SEQ ID NO: 8124 - protein, 7 aa, Artificial Sequence
  Description of Artificial Sequence: Synthetic peptide
DDNDRPS

SEQ ID NO: 8125 - DNA, 21 bp, Artificial Sequence
  Description of Artificial Sequence: Synthetic oligonucleotide
gatgataacgaccggccctca

SEQ ID NO: 8126 - protein, 7 aa, Artificial Sequence
  Description of Artificial Sequence: Synthetic peptide
DDNDRPS

SEQ ID NO: 8127 - DNA, 21 bp, Artificial Sequence
  Description of Artificial Sequence: Synthetic oligonucleotide
gatgataacgaccggccctca

SEQ ID NO: 8128 - protein, 7 aa, Artificial Sequence
  Description of Artificial Sequence: Synthetic peptide
DDNDRPS

SEQ ID NO: 8129 - DNA, 21 bp, Artificial Sequence
  Description of Artificial Sequence: Synthetic oligonucleotide
gatgataacgaccggccctca

SEQ ID NO: 8130 - protein, 7 aa, Artificial Sequence
  Description of Artificial Sequence: Synthetic peptide
DDNDRPS

SEQ ID NO: 8131 - DNA, 21 bp, Artificial Sequence
  Description of Artificial Sequence: Synthetic oligonucleotide
gatgataacgaccggccctca

SEQ ID NO: 8132 - protein, 7 aa, Artificial Sequence
  Description of Artificial Sequence: Synthetic peptide
DDNDRPS

SEQ ID NO: 8133 - DNA, 21 bp, Artificial Sequence
  Description of Artificial Sequence: Synthetic oligonucleotide
gatgataacgaccggccctca

SEQ ID NO: 8134 - protein, 7 aa, Artificial Sequence
  Description of Artificial Sequence: Synthetic peptide
DDNDRPS

SEQ ID NO: 8135 - DNA, 21 bp, Artificial Sequence
  Description of Artificial Sequence: Synthetic oligonucleotide
gatgataacgaccggccctca

SEQ ID NO: 8136 - protein, 7 aa, Artificial Sequence
  Description of Artificial Sequence: Synthetic peptide
DDNDRPS

SEQ ID NO: 8137 - DNA, 21 bp, Artificial Sequence
  Description of Artificial Sequence: Synthetic oligonucleotide
gatgataacgaccggccctca

SEQ ID NO: 8138 - protein, 7 aa, Artificial Sequence
  Description of Artificial Sequence: Synthetic peptide
DDNDRPS

SEQ ID NO: 8139 - DNA, 21 bp, Artificial Sequence
  Description of Artificial Sequence: Synthetic oligonucleotide
gatgataacgaccggccctca

SEQ ID NO: 8140 - protein, 7 aa, Artificial Sequence
  Description of Artificial Sequence: Synthetic peptide
DDNDRPS

SEQ ID NO: 8141 - DNA, 21 bp, Artificial Sequence
  Description of Artificial Sequence: Synthetic oligonucleotide
gatgataacgaccggccctca

SEQ ID NO: 8142 - protein, 7 aa, Artificial Sequence
  Description of Artificial Sequence: Synthetic peptide
DDNDRPS

SEQ ID NO: 8143 - DNA, 21 bp, Artificial Sequence
  Description of Artificial Sequence: Synthetic oligonucleotide
gatgataacgaccggccctca

SEQ ID NO: 8144 - protein, 7 aa, Artificial Sequence
  Description of Artificial Sequence: Synthetic peptide
DDNDRPS

SEQ ID NO: 8145 - DNA, 21 bp, Artificial Sequence
  Description of Artificial Sequence: Synthetic oligonucleotide
gatgataacgaccggccctca

SEQ ID NO: 8146 - protein, 7 aa, Artificial Sequence
  Description of Artificial Sequence: Synthetic peptide
DDNDRPS

SEQ ID NO: 8147 - DNA, 21 bp, Artificial Sequence
  Description of Artificial Sequence: Synthetic oligonucleotide
gatgataacgaccggccctca

SEQ ID NO: 8148 - protein, 7 aa, Artificial Sequence
  Description of Artificial Sequence: Synthetic peptide
DDNDRPS

SEQ ID NO: 8149 - DNA, 21 bp, Artificial Sequence
  Description of Artificial Sequence: Synthetic oligonucleotide
gatgataacgaccggccctca

SEQ ID NO: 8150 - protein, 7 aa, Artificial Sequence
  Description of Artificial Sequence: Synthetic peptide
DDNDRPS

SEQ ID NO: 8151 - DNA, 21 bp, Artificial Sequence
  Description of Artificial Sequence: Synthetic oligonucleotide
gatgataacgaccggccctca

SEQ ID NO: 8152 - protein, 7 aa, Artificial Sequence
  Description of Artificial Sequence: Synthetic peptide
DDNDRPS

SEQ ID NO: 8153 - DNA, 21 bp, Artificial Sequence
  Description of Artificial Sequence: Synthetic oligonucleotide
gatgataacgaccggccctca

SEQ ID NO: 8154 - protein, 7 aa, Artificial Sequence
  Description of Artificial Sequence: Synthetic peptide
DDNDRPS

SEQ ID NO: 8155 - DNA, 21 bp, Artificial Sequence
  Description of Artificial Sequence: Synthetic oligonucleotide
gatgataacgaccggccctca

SEQ ID NO: 8156 - protein, 7 aa, Artificial Sequence
  Description of Artificial Sequence: Synthetic peptide
DDNDRPS

SEQ ID NO: 8157 - DNA, 21 bp, Artificial Sequence
  Description of Artificial Sequence: Synthetic oligonucleotide
gatgataacgaccggccctca

SEQ ID NO: 8158 - protein, 7 aa, Artificial Sequence
  Description of Artificial Sequence: Synthetic peptide
DDNDRPS

SEQ ID NO: 8159 - DNA, 21 bp, Artificial Sequence
  Description of Artificial Sequence: Synthetic oligonucleotide
gatgataacgaccggccctca

SEQ ID NO: 8160 - protein, 7 aa, Artificial Sequence
  Description of Artificial Sequence: Synthetic peptide
DDNDRPS

SEQ ID NO: 8161 - DNA, 21 bp, Artificial Sequence
  Description of Artificial Sequence: Synthetic oligonucleotide
gatgataacgaccggccctca

SEQ ID NO: 8162 - protein, 7 aa, Artificial Sequence
  Description of Artificial Sequence: Synthetic peptide
DDNDRPS

SEQ ID NO: 8163 - DNA, 21 bp, Artificial Sequence
  Description of Artificial Sequence: Synthetic oligonucleotide
gatgataacgaccggccctca

SEQ ID NO: 8164 - protein, 7 aa, Artificial Sequence
  Description of Artificial Sequence: Synthetic peptide
DDNDRPS

SEQ ID NO: 8165 - DNA, 21 bp, Artificial Sequence
  Description of Artificial Sequence: Synthetic oligonucleotide
gatgataacgaccggccctca

SEQ ID NO: 8166 - protein, 7 aa, Artificial Sequence
  Description of Artificial Sequence: Synthetic peptide
DDNDRPS

SEQ ID NO: 8167 - DNA, 21 bp, Artificial Sequence
  Description of Artificial Sequence: Synthetic oligonucleotide
gatgataacgaccggccctca

SEQ ID NO: 8168 - protein, 7 aa, Artificial Sequence
  Description of Artificial Sequence: Synthetic peptide
DDNDRPS

SEQ ID NO: 8169 - DNA, 21 bp, Artificial Sequence
  Description of Artificial Sequence: Synthetic oligonucleotide
gctgcatccactttgcaatca

SEQ ID NO: 8170 - protein, 7 aa, Artificial Sequence
  Description of Artificial Sequence: Synthetic peptide
AASTLQS

SEQ ID NO: 8171 - DNA, 21 bp, Artificial Sequence
  Description of Artificial Sequence: Synthetic oligonucleotide
gctgcatccactttgcaatca

SEQ ID NO: 8172 - protein, 7 aa, Artificial Sequence
  Description of Artificial Sequence: Synthetic peptide
AASTLQS

SEQ ID NO: 8173 - DNA, 21 bp, Artificial Sequence
  Description of Artificial Sequence: Synthetic oligonucleotide
gctgcatccactttgcaatca

SEQ ID NO: 8174 - protein, 7 aa, Artificial Sequence
  Description of Artificial Sequence: Synthetic peptide
AASTLQS

SEQ ID NO: 8175 - DNA, 21 bp, Artificial Sequence
  Description of Artificial Sequence: Synthetic oligonucleotide
gatgatagcgaccggccctca

SEQ ID NO: 8176 - protein, 7 aa, Artificial Sequence
  Description of Artificial Sequence: Synthetic peptide
DDSDRPS

SEQ ID NO: 8177 - DNA, 21 bp, Artificial Sequence
  Description of Artificial Sequence: Synthetic oligonucleotide
gatgataacgaccggccctca

SEQ ID NO: 8178 - protein, 7 aa, Artificial Sequence
  Description of Artificial Sequence: Synthetic peptide
DDNDRPS

SEQ ID NO: 8179 - DNA, 21 bp, Artificial Sequence
  Description of Artificial Sequence: Synthetic oligonucleotide
gatgataacgaccggccctca

SEQ ID NO: 8180 - protein, 7 aa, Artificial Sequence
  Description of Artificial Sequence: Synthetic peptide
DDNDRPS

SEQ ID NO: 8181 - DNA, 21 bp, Artificial Sequence
  Description of Artificial Sequence: Synthetic oligonucleotide
gatgataacgaccggccctca

SEQ ID NO: 8182 - protein, 7 aa, Artificial Sequence
  Description of Artificial Sequence: Synthetic peptide
DDNDRPS

SEQ ID NO: 8183 - DNA, 21 bp, Artificial Sequence
  Description of Artificial Sequence: Synthetic oligonucleotide
gatgataacgaccggccctca

SEQ ID NO: 8184 - protein, 7 aa, Artificial Sequence
  Description of Artificial Sequence: Synthetic peptide
DDNDRPS

SEQ ID NO: 8185 - DNA, 21 bp, Artificial Sequence
  Description of Artificial Sequence: Synthetic oligonucleotide
gatgataacgaccggccctca

SEQ ID NO: 8186 - protein, 7 aa, Artificial Sequence
  Description of Artificial Sequence: Synthetic peptide
DDNDRPS

SEQ ID NO: 8187 - DNA, 21 bp, Artificial Sequence
  Description of Artificial Sequence: Synthetic oligonucleotide
gatgataacgaccggccctca

SEQ ID NO: 8188 - protein, 7 aa, Artificial Sequence
  Description of Artificial Sequence: Synthetic peptide
DDNDRPS

SEQ ID NO: 8189 - DNA, 21 bp, Artificial Sequence
  Description of Artificial Sequence: Synthetic oligonucleotide
gatgataacgaccggccctca

SEQ ID NO: 8190 - protein, 7 aa, Artificial Sequence
  Description of Artificial Sequence: Synthetic peptide
DDNDRPS

SEQ ID NO: 8191 - DNA, 21 bp, Artificial Sequence
  Description of Artificial Sequence: Synthetic oligonucleotide
gatgataacgaccggccctca

SEQ ID NO: 8192 - protein, 7 aa, Artificial Sequence
  Description of Artificial Sequence: Synthetic peptide
DDNDRPS

SEQ ID NO: 8193 - DNA, 21 bp, Artificial Sequence
  Description of Artificial Sequence: Synthetic oligonucleotide
gatgataacgaccggccctca

SEQ ID NO: 8194 - protein, 7 aa, Artificial Sequence
  Description of Artificial Sequence: Synthetic peptide
DDNDRPS

SEQ ID NO: 8195 - DNA, 21 bp, Artificial Sequence
  Description of Artificial Sequence: Synthetic oligonucleotide
gatgataacgaccggccctca

SEQ ID NO: 8196 - protein, 7 aa, Artificial Sequence
  Description of Artificial Sequence: Synthetic peptide
DDNDRPS

SEQ ID NO: 8197 - DNA, 21 bp, Artificial Sequence
  Description of Artificial Sequence: Synthetic oligonucleotide
gatgataacgaccggccctca

SEQ ID NO: 8198 - protein, 7 aa, Artificial Sequence
  Description of Artificial Sequence: Synthetic peptide
DDNDRPS

SEQ ID NO: 8199 - DNA, 21 bp, Artificial Sequence
  Description of Artificial Sequence: Synthetic oligonucleotide
gatgataacgaccggccctca

SEQ ID NO: 8200 - protein, 7 aa, Artificial Sequence
  Description of Artificial Sequence: Synthetic peptide
DDNDRPS

SEQ ID NO: 8201 - DNA, 21 bp, Artificial Sequence
  Description of Artificial Sequence: Synthetic oligonucleotide
tgggcatctacccgggaatcc

SEQ ID NO: 8202 - protein, 7 aa, Artificial Sequence
  Description of Artificial Sequence: Synthetic peptide
WASTRES

SEQ ID NO: 8203 - DNA, 21 bp, Artificial Sequence
  Description of Artificial Sequence: Synthetic oligonucleotide
tgggcatctacccgggaatcc

SEQ ID NO: 8204 - protein, 7 aa, Artificial Sequence
  Description of Artificial Sequence: Synthetic peptide
WASTRES

SEQ ID NO: 8205 - DNA, 21 bp, Artificial Sequence
  Description of Artificial Sequence: Synthetic oligonucleotide
gctgcatccagtttgcaaagt

SEQ ID NO: 8206 - protein, 7 aa, Artificial Sequence
  Description of Artificial Sequence: Synthetic peptide
AASSLQS

SEQ ID NO: 8207 - DNA, 21 bp, Artificial Sequence
  Description of Artificial Sequence: Synthetic oligonucleotide
gctgcatccagtttgcaaagt

SEQ ID NO: 8208 - protein, 7 aa, Artificial Sequence
  Description of Artificial Sequence: Synthetic peptide
AASSLQS

SEQ ID NO: 8209 - DNA, 21 bp, Artificial Sequence
  Description of Artificial Sequence: Synthetic oligonucleotide
gctgcatccagtttgcaaagt

SEQ ID NO: 8210 - protein, 7 aa, Artificial Sequence
  Description of Artificial Sequence: Synthetic peptide
AASSLQS

SEQ ID NO: 8211 - DNA, 21 bp, Artificial Sequence
  Description of Artificial Sequence: Synthetic oligonucleotide
gctgcatccagtttgcaaagt

SEQ ID NO: 8212 - protein, 7 aa, Artificial Sequence
  Description of Artificial Sequence: Synthetic peptide
AASSLQS

SEQ ID NO: 8213 - DNA, 21 bp, Artificial Sequence
  Description of Artificial Sequence: Synthetic oligonucleotide
gctgcatccagtttgcaaagt

SEQ ID NO: 8214 - protein, 7 aa, Artificial Sequence
  Description of Artificial Sequence: Synthetic peptide
AASSLQS

SEQ ID NO: 8215 - DNA, 21 bp, Artificial Sequence
  Description of Artificial Sequence: Synthetic oligonucleotide
gctgcatccagtttgcaaagt

SEQ ID NO: 8216 - protein, 7 aa, Artificial Sequence
  Description of Artificial Sequence: Synthetic peptide
AASSLQS

SEQ ID NO: 8217 - DNA, 21 bp, Artificial Sequence
  Description of Artificial Sequence: Synthetic oligonucleotide
gctgcatccagtttgcaaagt

SEQ ID NO: 8218 - protein, 7 aa, Artificial Sequence
  Description of Artificial Sequence: Synthetic peptide
AASSLQS

SEQ ID NO: 8219 - DNA, 21 bp, Artificial Sequence
  Description of Artificial Sequence: Synthetic oligonucleotide
gctgcatccagtttgcaaggt

SEQ ID NO: 8220 - protein, 7 aa, Artificial Sequence
  Description of Artificial Sequence: Synthetic peptide
AASSLQG

SEQ ID NO: 8221 - DNA, 21 bp, Artificial Sequence
  Description of Artificial Sequence: Synthetic oligonucleotide
gctgcatccagtttgcaaagt

SEQ ID NO: 8222 - protein, 7 aa, Artificial Sequence
  Description of Artificial Sequence: Synthetic peptide
AASSLQS

SEQ ID NO: 8223 - DNA, 21 bp, Artificial Sequence
  Description of Artificial Sequence: Synthetic oligonucleotide
gctgcatccagtttgcaaagt

SEQ ID NO: 8224 - protein, 7 aa, Artificial Sequence
  Description of Artificial Sequence: Synthetic peptide
AASSLQS

SEQ ID NO: 8225 - DNA, 21 bp, Artificial Sequence
  Description of Artificial Sequence: Synthetic oligonucleotide
gctgcatccagtttgcaaggt

SEQ ID NO: 8226 - protein, 7 aa, Artificial Sequence
  Description of Artificial Sequence: Synthetic peptide
AASSLQG

SEQ ID NO: 8227 - DNA, 21 bp, Artificial Sequence
  Description of Artificial Sequence: Synthetic oligonucleotide
gctgcatccagtttgcaaggt

SEQ ID NO: 8228 - protein, 7 aa, Artificial Sequence
  Description of Artificial Sequence: Synthetic peptide
AASSLQG

SEQ ID NO: 8229 - DNA, 21 bp, Artificial Sequence
  Description of Artificial Sequence: Synthetic oligonucleotide
gctgcatccagtttgcaaggt

SEQ ID NO: 8230 - protein, 7 aa, Artificial Sequence
  Description of Artificial Sequence: Synthetic peptide
AASSLQG

SEQ ID NO: 8231 - DNA, 21 bp, Artificial Sequence
  Description of Artificial Sequence: Synthetic oligonucleotide
ttgggttctaatcgggcctcc

SEQ ID NO: 8232 - protein, 7 aa, Artificial Sequence
  Description of Artificial Sequence: Synthetic peptide
LGSNRAS

SEQ ID NO: 8233 - DNA, 21 bp, Artificial Sequence
  Description of Artificial Sequence: Synthetic oligonucleotide
ttgggttctaatcgggcctcc

SEQ ID NO: 8234 - protein, 7 aa, Artificial Sequence
  Description of Artificial Sequence: Synthetic peptide
LGSNRAS

SEQ ID NO: 8235 - DNA, 21 bp, Artificial Sequence
  Description of Artificial Sequence: Synthetic oligonucleotide
gctgcatccagtttgcaaagt

SEQ ID NO: 8236 - protein, 7 aa, Artificial Sequence
  Description of Artificial Sequence: Synthetic peptide
AASSLQS

SEQ ID NO: 8237 - DNA, 21 bp, Artificial Sequence
  Description of Artificial Sequence: Synthetic oligonucleotide
gctgcatccagtttgcaaggt

SEQ ID NO: 8238 - protein, 7 aa, Artificial Sequence
  Description of Artificial Sequence: Synthetic peptide
AASSLQG

SEQ ID NO: 8239 - DNA, 21 bp, Artificial Sequence
  Description of Artificial Sequence: Synthetic oligonucleotide
gctgcatccagtttgcaaggt

SEQ ID NO: 8240 - protein, 7 aa, Artificial Sequence
  Description of Artificial Sequence: Synthetic peptide
AASSLQG

SEQ ID NO: 8241 - DNA, 21 bp, Artificial Sequence
  Description of Artificial Sequence: Synthetic oligonucleotide
ttgggttctaatcgggcctcc

SEQ ID NO: 8242 - protein, 7 aa, Artificial Sequence
  Description of Artificial Sequence: Synthetic peptide
LGSNRAS

SEQ ID NO: 8243 - DNA, 21 bp, Artificial Sequence
  Description of Artificial Sequence: Synthetic oligonucleotide
ttgggttctaatcgggcctcc

SEQ ID NO: 8244 - protein, 7 aa, Artificial Sequence
  Description of Artificial Sequence: Synthetic peptide
LGSNRAS

SEQ ID NO: 8245 - DNA, 21 bp, Artificial Sequence
  Description of Artificial Sequence: Synthetic oligonucleotide
ttgggttctaatcgggcctcc

SEQ ID NO: 8246 - protein, 7 aa, Artificial Sequence
  Description of Artificial Sequence: Synthetic peptide
LGSNRAS

SEQ ID NO: 8247 - DNA, 21 bp, Artificial Sequence
  Description of Artificial Sequence: Synthetic oligonucleotide
gctgcatccagtttgcaaggt

SEQ ID NO: 8248 - protein, 7 aa, Artificial Sequence
  Description of Artificial Sequence: Synthetic peptide
AASSLQG

SEQ ID NO: 8249 - protein, 7 aa, Artificial Sequence
  Description of Artificial Sequence: Synthetic peptide
DDNDRPS

SEQ ID NO: 8250 - protein, 7 aa, Artificial Sequence
  Description of Artificial Sequence: Synthetic peptide
DDNDRPS

SEQ ID NO: 8251 - protein, 7 aa, Artificial Sequence
  Description of Artificial Sequence: Synthetic peptide
AASTLQS

SEQ ID NO: 8252 - protein, 7 aa, Artificial Sequence
  Description of Artificial Sequence: Synthetic peptide
DDADRPS

SEQ ID NO: 8253 - protein, 7 aa, Artificial Sequence
  Description of Artificial Sequence: Synthetic peptide
LGSNRAS

SEQ ID NO: 8254 - protein, 7 aa, Artificial Sequence
  Description of Artificial Sequence: Synthetic peptide
WASTRES

SEQ ID NO: 8255 - protein, 7 aa, Artificial Sequence
  Description of Artificial Sequence: Synthetic peptide
DDNDRPS

SEQ ID NO: 8256 - protein, 7 aa, Artificial Sequence
  Description of Artificial Sequence: Synthetic peptide
DDNDRPS

SEQ ID NO: 8257 - protein, 7 aa, Artificial Sequence
  Description of Artificial Sequence: Synthetic peptide
DDNDRPS

SEQ ID NO: 8258 - protein, 7 aa, Artificial Sequence
  Description of Artificial Sequence: Synthetic peptide
DDNDRPS

SEQ ID NO: 8259 - protein, 7 aa, Artificial Sequence
  Description of Artificial Sequence: Synthetic peptide
DDNDRPS

SEQ ID NO: 8260 - protein, 7 aa, Artificial Sequence
  Description of Artificial Sequence: Synthetic peptide
DDNDRPS

SEQ ID NO: 8261 - protein, 7 aa, Artificial Sequence
  Description of Artificial Sequence: Synthetic peptide
DDNDRPS

SEQ ID NO: 8262 - protein, 7 aa, Artificial Sequence
  Description of Artificial Sequence: Synthetic peptide
DDNDRPS

SEQ ID NO: 8263 - protein, 7 aa, Artificial Sequence
  Description of Artificial Sequence: Synthetic peptide
AASSLQG

SEQ ID NO: 8264 - protein, 7 aa, Artificial Sequence
  Description of Artificial Sequence: Synthetic peptide
AASSLQS

SEQ ID NO: 8265 - protein, 7 aa, Artificial Sequence
  Description of Artificial Sequence: Synthetic peptide
AASSLQS

SEQ ID NO: 8266 - protein, 7 aa, Artificial Sequence
  Description of Artificial Sequence: Synthetic peptide
AASSLQS

SEQ ID NO: 8267 - protein, 7 aa, Artificial Sequence
  Description of Artificial Sequence: Synthetic peptide
AASSLQS

SEQ ID NO: 8268 - protein, 7 aa, Artificial Sequence
  Description of Artificial Sequence: Synthetic peptide
AASSLQG

SEQ ID NO: 8269 - protein, 7 aa, Artificial Sequence
  Description of Artificial Sequence: Synthetic peptide
AASSLQG

SEQ ID NO: 8270 - protein, 7 aa, Artificial Sequence
  Description of Artificial Sequence: Synthetic peptide
AASSLQG

SEQ ID NO: 8271 - protein, 7 aa, Artificial Sequence
  Description of Artificial Sequence: Synthetic peptide
AASSLQG

SEQ ID NO: 8272 - protein, 7 aa, Artificial Sequence
  Description of Artificial Sequence: Synthetic peptide
DDNDRPS

SEQ ID NO: 8273 - protein, 7 aa, Artificial Sequence
  Description of Artificial Sequence: Synthetic peptide
DDNDRPS

SEQ ID NO: 8274 - protein, 7 aa, Artificial Sequence
  Description of Artificial Sequence: Synthetic peptide
AASSLQS

SEQ ID NO: 8275 - protein, 7 aa, Artificial Sequence
  Description of Artificial Sequence: Synthetic peptide
AASSLQG

SEQ ID NO: 8276 - protein, 7 aa, Artificial Sequence
  Description of Artificial Sequence: Synthetic peptide
AASTLQS

SEQ ID NO: 8277 - DNA, 51 bp, Artificial Sequence
  Description of Artificial Sequence: Synthetic oligonucleotide
cggatttatcctggagatggagatactaactacaatgggaagttcaagggc

SEQ ID NO: 8278 - protein, 17 aa, Artificial Sequence
  Description of Artificial Sequence: Synthetic peptide
RIYPGDGDTNYNGKFKG

SEQ ID NO: 8279 - DNA, 51 bp, Artificial Sequence
  Description of Artificial Sequence: Synthetic oligonucleotide
cgtgtttggcctggagatggagatactacgtacaatgagaagttcaagggc

SEQ ID NO: 8280 - protein, 17 aa, Artificial Sequence
  Description of Artificial Sequence: Synthetic peptide
RVWPGDGDTTYNEKFKG

SEQ ID NO: 8281 - DNA, 51 bp, Artificial Sequence
  Description of Artificial Sequence: Synthetic oligonucleotide
cggatttatcctggagatggagatactaactacaatgggaagttcaaggac

SEQ ID NO: 8282 - protein, 17 aa, Artificial Sequence
  Description of Artificial Sequence: Synthetic peptide
RIYPGDGDTNYNGKFKD

SEQ ID NO: 8283 - DNA, 51 bp, Artificial Sequence
  Description of Artificial Sequence: Synthetic oligonucleotide
tggatgaaccctaacagtggtaacacaggctatgcacagaagttccagggc

SEQ ID NO: 8284 - protein, 17 aa, Artificial Sequence
  Description of Artificial Sequence: Synthetic peptide
WMNPNSGNTGYAQKFQG

SEQ ID NO: 8285 - DNA, 51 bp, Artificial Sequence; identical to SEQ ID NO: 8283
  Description of Artificial Sequence: Synthetic oligonucleotide

SEQ ID NO: 8286 - protein, 17 aa, Artificial Sequence
  Description of Artificial Sequence: Synthetic peptide
WMNPNSGNTGYAQKFQG

SEQ ID NO: 8287 - DNA, 48 bp, Artificial Sequence
  Description of Artificial Sequence: Synthetic oligonucleotide
gaaatcagtcatagtggaagcaccaactacaacccgtccctcaagagt

SEQ ID NO: 8288 - protein, 16 aa, Artificial Sequence
  Description of Artificial Sequence: Synthetic peptide
EISHSGSTNYNPSLKS

SEQ ID NO: 8289 - DNA, 51 bp, Artificial Sequence
  Description of Artificial Sequence: Synthetic oligonucleotide
gctattagtggtagtggtgatatcacatactacgcagactccgtgaagggc

SEQ ID NO: 8290 - protein, 17 aa, Artificial Sequence
  Description of Artificial Sequence: Synthetic peptide
AISGSGDITYYADSVKG

SEQ ID NO: 8291 - DNA, 51 bp, Artificial Sequence
  Description of Artificial Sequence: Synthetic oligonucleotide
gttatatcatatgatggaggtaataaatactatgcagactccgtgaagggc

SEQ ID NO: 8292 - protein, 17 aa, Artificial Sequence
  Description of Artificial Sequence: Synthetic peptide
VISYDGGNKYYADSVKG

SEQ ID NO: 8293 - DNA, 48 bp, Artificial Sequence
  Description of Artificial Sequence: Synthetic oligonucleotide
gaaatcaatcatagtggaagcaccaactacaacccgtccctcaagagt

SEQ ID NO: 8294 - protein, 16 aa, Artificial Sequence
  Description of Artificial Sequence: Synthetic peptide
EINHSGSTNYNPSLKS

SEQ ID NO: 8295 - DNA, 51 bp, Artificial Sequence
  Description of Artificial Sequence: Synthetic oligonucleotide
actattagtggtagtggtggtagcacagactacgcagactccgtgaagggc

SEQ ID NO: 8296 - protein, 17 aa, Artificial Sequence
  Description of Artificial Sequence: Synthetic peptide
TISGSGGSTDYADSVKG

SEQ ID NO: 8297 - DNA, 51 bp, Artificial Sequence
  Description of Artificial Sequence: Synthetic oligonucleotide
tggatgaaccctaaccgtggcaccacaggctatgcacagaagttccagggc

SEQ ID NO: 8298 - protein, 17 aa, Artificial Sequence
  Description of Artificial Sequence: Synthetic peptide
WMNPNRGTTGYAQKFQG

SEQ ID NO: 8299 - DNA, 51 bp, Artificial Sequence
  Description of Artificial Sequence: Synthetic oligonucleotide
gctattagtggtagtggtgattacacatactacgcagactccgtgaagggc

SEQ ID NO: 8300 - protein, 17 aa, Artificial Sequence
  Description of Artificial Sequence: Synthetic peptide
AISGSGDYTYYADSVKG

SEQ ID NO: 8301 - DNA, 48 bp, Artificial Sequence
  Description of Artificial Sequence: Synthetic oligonucleotide
gaaatcaatcacagtggaagaaccaactacaatccgtccctcaagagt

SEQ ID NO: 8302 - protein, 16 aa, Artificial Sequence
  Description of Artificial Sequence: Synthetic peptide
EINHSGRTNYNPSLKS

SEQ ID NO: 8303 - DNA, 48 bp, Artificial Sequence
  Description of Artificial Sequence: Synthetic oligonucleotide
gaaatcaatcatcgtggaagcaccaactacaacccgtccctcaagagt

SEQ ID NO: 8304 - protein, 16 aa, Artificial Sequence
  Description of Artificial Sequence: Synthetic peptide
EINHRGSTNYNPSLKS

SEQ ID NO: 8305 - DNA, 48 bp, Artificial Sequence; identical to SEQ ID NO: 8293
  Description of Artificial Sequence: Synthetic oligonucleotide

SEQ ID NO: 8306 - protein, 16 aa, Artificial Sequence
  Description of Artificial Sequence: Synthetic peptide
EINHSGSTNYNPSLKS

SEQ ID NO: 8307 - DNA, 48 bp, Artificial Sequence; identical to SEQ ID NO: 8303
  Description of Artificial Sequence: Synthetic oligonucleotide

SEQ ID NO: 8308 - protein, 16 aa, Artificial Sequence
  Description of Artificial Sequence: Synthetic peptide
EINHRGSTNYNPSLKS

SEQ ID NO: 8309 - DNA, 51 bp, Artificial Sequence
  Description of Artificial Sequence: Synthetic oligonucleotide
gctattagtggtagtggtggtagcacatactacgcagactccgcgaagggc

SEQ ID NO: 8310 - protein, 17 aa, Artificial Sequence
  Description of Artificial Sequence: Synthetic peptide
AISGSGGSTYYADSAKG

SEQ ID NO: 8311 - DNA, 48 bp, Artificial Sequence; identical to SEQ ID NO: 8293
  Description of Artificial Sequence: Synthetic oligonucleotide

SEQ ID NO: 8312 - protein, 16 aa, Artificial Sequence
  Description of Artificial Sequence: Synthetic peptide
EINHSGSTNYNPSLKS

SEQ ID NO: 8313 - DNA, 51 bp, Artificial Sequence; identical to SEQ ID NO: 8283
  Description of Artificial Sequence: Synthetic oligonucleotide

SEQ ID NO: 8314 - protein, 17 aa, Artificial Sequence
  Description of Artificial Sequence: Synthetic peptide
WMNPNSGNTGYAQKFQG

SEQ ID NO: 8315 - DNA, 48 bp, Artificial Sequence
  Description of Artificial Sequence: Synthetic oligonucleotide
gaaatcaatcatagtggaagcaccacctacaacccgtccctcaagagt

SEQ ID NO: 8316 - protein, 16 aa, Artificial Sequence
  Description of Artificial Sequence: Synthetic peptide
EINHSGSTTYNPSLKS

SEQ ID NO: 8317 - DNA, 48 bp, Artificial Sequence; identical to SEQ ID NO: 8303
  Description of Artificial Sequence: Synthetic oligonucleotide

SEQ ID NO: 8318 - protein, 16 aa, Artificial Sequence
  Description of Artificial Sequence: Synthetic peptide
EINHRGSTNYNPSLKS

SEQ ID NO: 8319 - DNA, 48 bp, Artificial Sequence; identical to SEQ ID NO: 8287
  Description of Artificial Sequence: Synthetic oligonucleotide

SEQ ID NO: 8320 - protein, 16 aa, Artificial Sequence
  Description of Artificial Sequence: Synthetic peptide
EISHSGSTNYNPSLKS

SEQ ID NO: 8321 - DNA, 48 bp, Artificial Sequence; identical to SEQ ID NO: 8293
  Description of Artificial Sequence: Synthetic oligonucleotide

SEQ ID NO: 8322 - protein, 16 aa, Artificial Sequence
  Description of Artificial Sequence: Synthetic peptide
EINHSGSTNYNPSLKS

SEQ ID NO: 8323 - DNA, 48 bp, Artificial Sequence
  Description of Artificial Sequence: Synthetic oligonucleotide
gaaatcactcatagtggaagcaccaactacaacccgtccctcaagagt

SEQ ID NO: 8324 - protein, 16 aa, Artificial Sequence
  Description of Artificial Sequence: Synthetic peptide
EITHSGSTNYNPSLKS

SEQ ID NO: 8325 - DNA, 51 bp, Artificial Sequence
  Description of Artificial Sequence: Synthetic oligonucleotide
gctattagtggtagtggtggtagcacatactacgcagactccgtgaagggc

SEQ ID NO: 8326 - protein, 17 aa, Artificial Sequence
  Description of Artificial Sequence: Synthetic peptide
AISGSGGSTYYADSVKG

SEQ ID NO: 8327 - DNA, 51 bp, Artificial Sequence; identical to SEQ ID NO: 8325
  Description of Artificial Sequence: Synthetic oligonucleotide

SEQ ID NO: 8328 - protein, 17 aa, Artificial Sequence
  Description of Artificial Sequence: Synthetic peptide
AISGSGGSTYYADSVKG

SEQ ID NO: 8329 - DNA, 48 bp, Artificial Sequence; identical to SEQ ID NO: 8293
  Description of Artificial Sequence: Synthetic oligonucleotide

SEQ ID NO: 8330 - protein, 16 aa, Artificial Sequence
  Description of Artificial Sequence: Synthetic peptide
EINHSGSTNYNPSLKS

SEQ ID NO: 8331 - DNA, 48 bp, Artificial Sequence
  Description of Artificial Sequence: Synthetic oligonucleotide
tacatctattacagtgggagcacctactacaacccgtccctcaagagt

SEQ ID NO: 8332 - protein, 16 aa, Artificial Sequence
  Description of Artificial Sequence: Synthetic peptide
YIYYSGSTYYNPSLKS

SEQ ID NO: 8333 - DNA, 48 bp, Artificial Sequence; identical to SEQ ID NO: 8293
  Description of Artificial Sequence: Synthetic oligonucleotide

SEQ ID NO: 8334 - protein, 16 aa, Artificial Sequence
  Description of Artificial Sequence: Synthetic peptide
EINHSGSTNYNPSLKS

SEQ ID NO: 8335 - DNA, 48 bp, Artificial Sequence; identical to SEQ ID NO: 8293
  Description of Artificial Sequence: Synthetic oligonucleotide

SEQ ID NO: 8336 - protein, 16 aa, Artificial Sequence
  Description of Artificial Sequence: Synthetic peptide
EINHSGSTNYNPSLKS

SEQ ID NO: 8337 - DNA, 51 bp, Artificial Sequence; identical to SEQ ID NO: 8325
  Description of Artificial Sequence: Synthetic oligonucleotide

SEQ ID NO: 8338 - protein, 17 aa, Artificial Sequence
  Description of Artificial Sequence: Synthetic peptide
AISGSGGSTYYADSVKG

SEQ ID NO: 8339 - DNA, 48 bp, Artificial Sequence; identical to SEQ ID NO: 8301
  Description of Artificial Sequence: Synthetic oligonucleotide

SEQ ID NO: 8340 - protein, 16 aa, Artificial Sequence
  Description of Artificial Sequence: Synthetic peptide
EINHSGRTNYNPSLKS

SEQ ID NO: 8341 - DNA, 48 bp, Artificial Sequence; identical to SEQ ID NO: 8293
  Description of Artificial Sequence: Synthetic oligonucleotide

SEQ ID NO: 8342 - protein, 16 aa, Artificial Sequence
  Description of Artificial Sequence: Synthetic peptide
EINHSGSTNYNPSLKS

SEQ ID NO: 8343 - DNA, 48 bp, Artificial Sequence; identical to SEQ ID NO: 8303
  Description of Artificial Sequence: Synthetic oligonucleotide

SEQ ID NO: 8344 - protein, 16 aa, Artificial Sequence
  Description of Artificial Sequence: Synthetic peptide
EINHRGSTNYNPSLKS

SEQ ID NO: 8345 - DNA, 51 bp, Artificial Sequence; identical to SEQ ID NO: 8283
  Description of Artificial Sequence: Synthetic oligonucleotide

SEQ ID NO: 8346 - protein, 17 aa, Artificial Sequence
  Description of Artificial Sequence: Synthetic peptide
WMNPNSGNTGYAQKFQG

SEQ ID NO: 8347 - DNA, 51 bp, Artificial Sequence
  Description of Artificial Sequence: Synthetic oligonucleotide
cttatatggtatgatggaagtaataaatactatgcagactccgtgaagggc

SEQ ID NO: 8348 - protein, 17 aa, Artificial Sequence
  Description of Artificial Sequence: Synthetic peptide
LIWYDGSNKYYADSVKG

SEQ ID NO: 8349 - DNA, 51 bp, Artificial Sequence
  Description of Artificial Sequence: Synthetic oligonucleotide
tggatgaaccctaacagtggtaacacagactatgcacagaagttccagggc

SEQ ID NO: 8350 - protein, 17 aa, Artificial Sequence
  Description of Artificial Sequence: Synthetic peptide
WMNPNSGNTDYAQKFQG

SEQ ID NO: 8351 - DNA, 51 bp, Artificial Sequence; identical to SEQ ID NO: 8349
  Description of Artificial Sequence: Synthetic oligonucleotide

SEQ ID NO: 8352 - protein, 17 aa, Artificial Sequence
  Description of Artificial Sequence: Synthetic peptide
WMNPNSGNTDYAQKFQG

SEQ ID NO: 8353 - DNA, 51 bp, Artificial Sequence; identical to SEQ ID NO: 8289
  Description of Artificial Sequence: Synthetic oligonucleotide

SEQ ID NO: 8354 - protein, 17 aa, Artificial Sequence
  Description of Artificial Sequence: Synthetic peptide
AISGSGDITYYADSVKG

SEQ ID NO: 8355 - DNA, 51 bp, Artificial Sequence
  Description of Artificial Sequence: Synthetic oligonucleotide
tccattagtagtagtagtagttacatatactacgcagactcagtgaagggc

SEQ ID NO: 8356 - protein, 17 aa, Artificial Sequence
  Description of Artificial Sequence: Synthetic peptide
SISSSSSYIYYADSVKG

SEQ ID NO: 8357 - DNA, 51 bp, Artificial Sequence
  Description of Artificial Sequence: Synthetic oligonucleotide
agcataactattactggtggtagcacatactacgcagactccgtgaagggc

SEQ ID NO: 8358 - protein, 17 aa, Artificial Sequence
  Description of Artificial Sequence: Synthetic peptide
SITITGGSTYYADSVKG

SEQ ID NO: 8359 - DNA, 51 bp, Artificial Sequence
  Description of Artificial Sequence: Synthetic oligonucleotide
gttatatcatatgatggaagtaataaatactatgcagactccgtgaagggc

SEQ ID NO: 8360 - protein, 17 aa, Artificial Sequence
  Description of Artificial Sequence: Synthetic peptide
VISYDGSNKYYADSVKG

SEQ ID NO: 8361 - DNA, 51 bp, Artificial Sequence
  Description of Artificial Sequence: Synthetic oligonucleotide
gttatatcatatgatggaagtaataagtactatgcagactccgtgaagggc

SEQ ID NO: 8362 - protein, 17 aa, Artificial Sequence
  Description of Artificial Sequence: Synthetic peptide
VISYDGSNKYYADSVKG

SEQ ID NO: 8363 - DNA, 51 bp, Artificial Sequence; identical to SEQ ID NO: 8349
  Description of Artificial Sequence: Synthetic oligonucleotide

SEQ ID NO: 8364 - protein, 17 aa, Artificial Sequence
  Description of Artificial Sequence: Synthetic peptide
WMNPNSGNTDYAQKFQG

SEQ ID NO: 8365 - DNA, 51 bp, Artificial Sequence
  Description of Artificial Sequence: Synthetic oligonucleotide
tggatgaaccctaacagtggtaacacagactatacacagaagttccagggc

SEQ ID NO: 8366 - protein, 17 aa, Artificial Sequence
  Description of Artificial Sequence: Synthetic peptide
WMNPNSGNTDYTQKFQG

SEQ ID NO: 8367 - DNA, 48 bp, Artificial Sequence
  Description of Artificial Sequence: Synthetic oligonucleotide
tacatcaatgacagtgggagcacctactataacccgtccctcaagagt

SEQ ID NO: 8368 - protein, 16 aa, Artificial Sequence
  Description of Artificial Sequence: Synthetic peptide
YINDSGSTYYNPSLKS

SEQ ID NO: 8369 - DNA, 51 bp, Artificial Sequence
  Description of Artificial Sequence: Synthetic oligonucleotide
ggtattagtggtagtggtggtagcacatactacgcagactccgtgaagggc

SEQ ID NO: 8370 - protein, 17 aa, Artificial Sequence
  Description of Artificial Sequence: Synthetic peptide
GISGSGGSTYYADSVKG

SEQ ID NO: 8371 - DNA, 48 bp, Artificial Sequence
  Description of Artificial Sequence: Synthetic oligonucleotide
agtatctattatagtgggagcacctactacaacccgtccctcaagagt

SEQ ID NO: 8372 - protein, 16 aa, Artificial Sequence
  Description of Artificial Sequence: Synthetic peptide
SIYYSGSTYYNPSLKS

SEQ ID NO: 8373 - DNA, 54 bp, Artificial Sequence
  Description of Artificial Sequence: Synthetic oligonucleotide
aggacatactacaggtccaagtggtataatgattatgcagtatctgtgaaaagt

SEQ ID NO: 8374 - protein, 18 aa, Artificial Sequence
  Description of Artificial Sequence: Synthetic peptide
RTYYRSKWYNDYAVSVKS

SEQ ID NO: 8375 - DNA, 48 bp, Artificial Sequence
  Description of Artificial Sequence: Synthetic oligonucleotide
agtatctattatggtgggagcacctactacaacccgtccctcaagagt

SEQ ID NO: 8376 - protein, 16 aa, Artificial Sequence
  Description of Artificial Sequence: Synthetic peptide
SIYYGGSTYYNPSLKS

SEQ ID NO: 8377 - DNA, 48 bp, Artificial Sequence
  Description of Artificial Sequence: Synthetic oligonucleotide
ctcatttattggaatgatgatacgcgctacagcccatctctgcagagt

SEQ ID NO: 8378 - protein, 16 aa, Artificial Sequence
  Description of Artificial Sequence: Synthetic peptide
LIYWNDDTRYSPSLQS

SEQ ID NO: 8379 - DNA, 51 bp, Artificial Sequence; identical to SEQ ID NO: 8325
  Description of Artificial Sequence: Synthetic oligonucleotide

SEQ ID NO: 8380 - protein, 17 aa, Artificial Sequence
  Description of Artificial Sequence: Synthetic peptide
AISGSGGSTYYADSVKG

SEQ ID NO: 8381 - DNA, 51 bp, Artificial Sequence
  Description of Artificial Sequence: Synthetic oligonucleotide
gttatatggtatgatggaagtaataaatactatgcagactccgtgaagggc

SEQ ID NO: 8382 - protein, 17 aa, Artificial Sequence
  Description of Artificial Sequence: Synthetic peptide
VIWYDGSNKYYADSVKG

SEQ ID NO: 8383 - DNA, 51 bp, Artificial Sequence
  Description of Artificial Sequence: Synthetic oligonucleotide
gctattagtggtagtggtagtagcacatactacgcagactccgtgaagggc

SEQ ID NO: 8384 - protein, 17 aa, Artificial Sequence
  Description of Artificial Sequence: Synthetic peptide
AISGSGSSTYYADSVKG

SEQ ID NO: 8385 - DNA, 51 bp, Artificial Sequence
  Description of Artificial Sequence: Synthetic oligonucleotide
tggatgaaccctaagagtggtaacacaggctatgcacagaagttccaggac

SEQ ID NO: 8386 - protein, 17 aa, Artificial Sequence
  Description of Artificial Sequence: Synthetic peptide
WMNPKSGNTGYAQKFQD

SEQ ID NO: 8387 - DNA, 51 bp, Artificial Sequence; identical to SEQ ID NO: 8289
  Description of Artificial Sequence: Synthetic oligonucleotide

SEQ ID NO: 8388 - protein, 17 aa, Artificial Sequence
  Description of Artificial Sequence: Synthetic peptide
AISGSGDITYYADSVKG

SEQ ID NO: 8389 - DNA, 48 bp, Artificial Sequence; identical to SEQ ID NO: 8293
  Description of Artificial Sequence: Synthetic oligonucleotide

SEQ ID NO: 8390 - protein, 16 aa, Artificial Sequence
  Description of Artificial Sequence: Synthetic peptide
EINHSGSTNYNPSLKS

SEQ ID NO: 8391 - DNA, 48 bp, Artificial Sequence
  Description of Artificial Sequence: Synthetic oligonucleotide
agtatctattatggtgggagcacctactacaacccgtccctcaagaat

SEQ ID NO: 8392 - protein, 16 aa, Artificial Sequence
  Description of Artificial Sequence: Synthetic peptide
SIYYGGSTYYNPSLKN

SEQ ID NO: 8393 - DNA, 48 bp, Artificial Sequence
  Description of Artificial Sequence: Synthetic oligonucleotide
ctcatttattggaatgatgataagcgctacagtccatctctgaagagc

SEQ ID NO: 8394 - protein, 16 aa, Artificial Sequence
  Description of Artificial Sequence: Synthetic peptide
LIYWNDDKRYSPSLKS

SEQ ID NO: 8395 - DNA, 48 bp, Artificial Sequence
  Description of Artificial Sequence: Synthetic oligonucleotide
ctcatttattggaatgatgataagcgctacagcccatctctgcagagt

SEQ ID NO: 8396 - protein, 16 aa, Artificial Sequence
  Description of Artificial Sequence: Synthetic peptide
LIYWNDDKRYSPSLQS

SEQ ID NO: 8397 - DNA, 51 bp, Artificial Sequence
  Description of Artificial Sequence: Synthetic oligonucleotide
ggtattagtggtagtggtggtagctcatactacgcagactccgtgaagggc

SEQ ID NO: 8398 - protein, 17 aa, Artificial Sequence
  Description of Artificial Sequence: Synthetic peptide
GISGSGGSSYYADSVKG

SEQ ID NO: 8399 - DNA, 51 bp, Artificial Sequence; identical to SEQ ID NO: 8369
  Description of Artificial Sequence: Synthetic oligonucleotide

SEQ ID NO: 8400 - protein, 17 aa, Artificial Sequence
  Description of Artificial Sequence: Synthetic peptide
GISGSGGSTYYADSVKG

SEQ ID NO: 8401 - DNA, 51 bp, Artificial Sequence
  Description of Artificial Sequence: Synthetic oligonucleotide
gctattagtggtagtggtggtagtacatactacgcagactccgtgaagggc

SEQ ID NO: 8402 - protein, 17 aa, Artificial Sequence
  Description of Artificial Sequence: Synthetic peptide
AISGSGGSTYYADSVKG

SEQ ID NO: 8403 - DNA, 51 bp, Artificial Sequence; identical to SEQ ID NO: 8359
  Description of Artificial Sequence: Synthetic oligonucleotide

SEQ ID NO: 8404 - protein, 17 aa, Artificial Sequence
  Description of Artificial Sequence: Synthetic peptide
VISYDGSNKYYADSVKG

SEQ ID NO: 8405 - DNA, 51 bp, Artificial Sequence
  Description of Artificial Sequence: Synthetic oligonucleotide
actattagtcatagtggtggtagcacatactacgcagactccgtgaagggc

SEQ ID NO: 8406 - protein, 17 aa, Artificial Sequence
  Description of Artificial Sequence: Synthetic peptide
TISHSGGSTYYADSVKG

SEQ ID NO: 8407 - DNA, 51 bp, Artificial Sequence; identical to SEQ ID NO: 8325
  Description of Artificial Sequence: Synthetic oligonucleotide

SEQ ID NO: 8408 - protein, 17 aa, Artificial Sequence
  Description of Artificial Sequence: Synthetic peptide
AISGSGGSTYYADSVKG

SEQ ID NO: 8409 - DNA, 48 bp, Artificial Sequence
  Description of Artificial Sequence: Synthetic oligonucleotide
tacatctcttacagtgggagcaccttctacaacccgtccctcaagagt

SEQ ID NO: 8410 - protein, 16 aa, Artificial Sequence
  Description of Artificial Sequence: Synthetic peptide
YISYSGSTFYNPSLKS

SEQ ID NO: 8411 - DNA, 48 bp, Artificial Sequence
  Description of Artificial Sequence: Synthetic oligonucleotide
tacatcgataagagtgggagcacctactacaacccgtccctcaagagt

SEQ ID NO: 8412 - protein, 16 aa, Artificial Sequence
  Description of Artificial Sequence: Synthetic peptide
YIDKSGSTYYNPSLKS

SEQ ID NO: 8413 - DNA, 48 bp, Artificial Sequence; identical to SEQ ID NO: 8411
  Description of Artificial Sequence: Synthetic oligonucleotide

SEQ ID NO: 8414 - protein, 16 aa, Artificial Sequence
  Description of Artificial Sequence: Synthetic peptide
YIDKSGSTYYNPSLKS

SEQ ID NO: 8415 - DNA, 48 bp, Artificial Sequence; identical to SEQ ID NO: 8411
  Description of Artificial Sequence: Synthetic oligonucleotide

SEQ ID NO: 8416 - protein, 16 aa, Artificial Sequence
  Description of Artificial Sequence: Synthetic peptide
YIDKSGSTYYNPSLKS

SEQ ID NO: 8417 - DNA, 57 bp, Artificial Sequence
  Description of Artificial Sequence: Synthetic oligonucleotide
cgtattaaaggcaacacttatggtgggacaacagactacgctgcacccgtgaaaggc

SEQ ID NO: 8418 - protein, 19 aa, Artificial Sequence
  Description of Artificial Sequence: Synthetic peptide
RIKGNTYGGTTDYAAPVKG

SEQ ID NO: 8419 - DNA, 57 bp, Artificial Sequence; identical to SEQ ID NO: 8417
  Description of Artificial Sequence: Synthetic oligonucleotide

SEQ ID NO: 8420 - protein, 19 aa, Artificial Sequence
  Description of Artificial Sequence: Synthetic peptide
RIKGNTYGGTTDYAAPVKG

SEQ ID NO: 8421 - DNA, 48 bp, Artificial Sequence; identical to SEQ ID NO: 8411
  Description of Artificial Sequence: Synthetic oligonucleotide

SEQ ID NO: 8422 - protein, 16 aa, Artificial Sequence
  Description of Artificial Sequence: Synthetic peptide
YIDKSGSTYYNPSLKS

SEQ ID NO: 8423 - DNA, 48 bp, Artificial Sequence; identical to SEQ ID NO: 8411
  Description of Artificial Sequence: Synthetic oligonucleotide

SEQ ID NO: 8424 - protein, 16 aa, Artificial Sequence
  Description of Artificial Sequence: Synthetic peptide
YIDKSGSTYYNPSLKS

SEQ ID NO: 8425 - DNA, 48 bp, Artificial Sequence
  Description of Artificial Sequence: Synthetic oligonucleotide
tacatctctcacagtgggagcacttattacaatccgtccctcaagagt

SEQ ID NO: 8426 - protein, 16 aa, Artificial Sequence
  Description of Artificial Sequence: Synthetic peptide
YISHSGSTYYNPSLKS

SEQ ID NO: 8427 - DNA, 48 bp, Artificial Sequence; identical to SEQ ID NO: 8425
  Description of Artificial Sequence: Synthetic oligonucleotide

SEQ ID NO: 8428 - protein, 16 aa, Artificial Sequence
  Description of Artificial Sequence: Synthetic peptide
YISHSGSTYYNPSLKS

SEQ ID NO: 8429 - DNA, 57 bp, Artificial Sequence; identical to SEQ ID NO: 8417
  Description of Artificial Sequence: Synthetic oligonucleotide

SEQ ID NO: 8430 - protein, 19 aa, Artificial Sequence
  Description of Artificial Sequence: Synthetic peptide
RIKGNTYGGTTDYAAPVKG

SEQ ID NO: 8431 - DNA, 57 bp, Artificial Sequence; identical to SEQ ID NO: 8417
  Description of Artificial Sequence: Synthetic oligonucleotide

SEQ ID NO: 8432 - protein, 19 aa, Artificial Sequence
  Description of Artificial Sequence: Synthetic peptide
RIKGNTYGGTTDYAAPVKG

SEQ ID NO: 8433 - DNA, 57 bp, Artificial Sequence; identical to SEQ ID NO: 8417
  Description of Artificial Sequence: Synthetic oligonucleotide

SEQ ID NO: 8434 - protein, 19 aa, Artificial Sequence
  Description of Artificial Sequence: Synthetic peptide
RIKGNTYGGTTDYAAPVKG

SEQ ID NO: 8435 - DNA, 48 bp, Artificial Sequence
  Description of Artificial Sequence: Synthetic oligonucleotide
catatctataccagtgggagcaccaactacaacccctccctcaagagt

SEQ ID NO: 8436 - protein, 16 aa, Artificial Sequence
  Description of Artificial Sequence: Synthetic peptide
HIYTSGSTNYNPSLKS

SEQ ID NO: 8437 - DNA, 48 bp, Artificial Sequence; identical to SEQ ID NO: 8409
  Description of Artificial Sequence: Synthetic oligonucleotide

SEQ ID NO: 8438 - protein, 16 aa, Artificial Sequence
  Description of Artificial Sequence: Synthetic peptide
YISYSGSTFYNPSLKS

SEQ ID NO: 8439 - DNA, 48 bp, Artificial Sequence; identical to SEQ ID NO: 8411
  Description of Artificial Sequence: Synthetic oligonucleotide

SEQ ID NO: 8440 - protein, 16 aa, Artificial Sequence
  Description of Artificial Sequence: Synthetic peptide
YIDKSGSTYYNPSLKS

SEQ ID NO: 8441 - DNA, 48 bp, Artificial Sequence
  Description of Artificial Sequence: Synthetic oligonucleotide
tatatctattacagagggagcaccaactaccacccctccctcaagagt

SEQ ID NO: 8442 - protein, 16 aa, Artificial Sequence
  Description of Artificial Sequence: Synthetic peptide
YIYYRGSTNYHPSLKS

SEQ ID NO: 8443 - DNA, 48 bp, Artificial Sequence; identical to SEQ ID NO: 8411
  Description of Artificial Sequence: Synthetic oligonucleotide

SEQ ID NO: 8444 - protein, 16 aa, Artificial Sequence
  Description of Artificial Sequence: Synthetic peptide
YIDKSGSTYYNPSLKS

SEQ ID NO: 8445 - DNA, 48 bp, Artificial Sequence
  Description of Artificial Sequence: Synthetic oligonucleotide
tacatctattacagtgggagcacctcctacaacccgtccctcaagagt

SEQ ID NO: 8446 - protein, 16 aa, Artificial Sequence
  Description of Artificial Sequence: Synthetic peptide
YIYYSGSTSYNPSLKS

SEQ ID NO: 8447 - DNA, 48 bp, Artificial Sequence; identical to SEQ ID NO: 8411
  Description of Artificial Sequence: Synthetic oligonucleotide

SEQ ID NO: 8448 - protein, 16 aa, Artificial Sequence
  Description of Artificial Sequence: Synthetic peptide
YIDKSGSTYYNPSLKS

SEQ ID NO: 8449 - DNA, 48 bp, Artificial Sequence; identical to SEQ ID NO: 8425
  Description of Artificial Sequence: Synthetic oligonucleotide

SEQ ID NO: 8450 - protein, 16 aa, Artificial Sequence
  Description of Artificial Sequence: Synthetic peptide
YISHSGSTYYNPSLKS

SEQ ID NO: 8451 - DNA, 48 bp, Artificial Sequence
  Description of Artificial Sequence: Synthetic oligonucleotide
tacatctcttacagtgggagcacctactacaacccgtccctcaagagt

SEQ ID NO: 8452 - protein, 16 aa, Artificial Sequence
  Description of Artificial Sequence: Synthetic peptide
YISYSGSTYYNPSLKS

SEQ ID NO: 8453 - DNA, 48 bp, Artificial Sequence; identical to SEQ ID NO: 8451
  Description of Artificial Sequence: Synthetic oligonucleotide

SEQ ID NO: 8454 - protein, 16 aa, Artificial Sequence
  Description of Artificial Sequence: Synthetic peptide
YISYSGSTYYNPSLKS

SEQ ID NO: 8455 - DNA, 57 bp, Artificial Sequence; identical to SEQ ID NO: 8417
  Description of Artificial Sequence: Synthetic oligonucleotide

SEQ ID NO: 8456 - protein, 19 aa, Artificial Sequence
  Description of Artificial Sequence: Synthetic peptide
RIKGNTYGGTTDYAAPVKG

SEQ ID NO: 8457 - DNA, 48 bp, Artificial Sequence
  Description of Artificial Sequence: Synthetic oligonucleotide
catatctataccagtgggagcaccaacttcaacccctccctcaagagt

SEQ ID NO: 8458 - protein, 16 aa, Artificial Sequence
  Description of Artificial Sequence: Synthetic peptide
HIYTSGSTNFNPSLKS

SEQ ID NO: 8459 - DNA, 51 bp, Artificial Sequence; identical to SEQ ID NO: 8325
  Description of Artificial Sequence: Synthetic oligonucleotide

SEQ ID NO: 8460 - protein, 17 aa, Artificial Sequence
  Description of Artificial Sequence: Synthetic peptide
AISGSGGSTYYADSVKG

SEQ ID NO: 8461 - DNA, 51 bp, Artificial Sequence
  Description of Artificial Sequence: Synthetic oligonucleotide
gctattagtggtagtggtggtggcacttactacgcagactccgtgaagggc

SEQ ID NO: 8462 - protein, 17 aa, Artificial Sequence
  Description of Artificial Sequence: Synthetic peptide
AISGSGGGTYYADSVKG

SEQ ID NO: 8463 - DNA, 51 bp, Artificial Sequence
  Description of Artificial Sequence: Synthetic oligonucleotide
actattagtggaagtggtggtggcacatactacgcagactccgtgaagggc

SEQ ID NO: 8464 - protein, 17 aa, Artificial Sequence
  Description of Artificial Sequence: Synthetic peptide
TISGSGGGTYYADSVKG

SEQ ID NO: 8465 - DNA, 51 bp, Artificial Sequence
  Description of Artificial Sequence: Synthetic oligonucleotide
gctattagtggaagtggtggtggcacatactacgcagactccgtgaagggc

SEQ ID NO: 8466 - protein, 17 aa, Artificial Sequence
  Description of Artificial Sequence: Synthetic peptide
AISGSGGGTYYADSVKG

SEQ ID NO: 8467 - DNA, 51 bp, Artificial Sequence
  Description of Artificial Sequence: Synthetic oligonucleotide
gctattagtggtagtggtggtggcacatacaacgcagactccgtgaagggc

SEQ ID NO: 8468 - protein, 17 aa, Artificial Sequence
  Description of Artificial Sequence: Synthetic peptide
AISGSGGGTYNADSVKG

SEQ ID NO: 8469 - DNA, 51 bp, Artificial Sequence; identical to SEQ ID NO: 8465
  Description of Artificial Sequence: Synthetic oligonucleotide

SEQ ID NO: 8470 - protein, 17 aa, Artificial Sequence
  Description of Artificial Sequence: Synthetic peptide
AISGSGGGTYYADSVKG

SEQ ID NO: 8471 - DNA, 51 bp, Artificial Sequence; identical to SEQ ID NO: 8467
  Description of Artificial Sequence: Synthetic oligonucleotide

SEQ ID NO: 8472 - protein, 17 aa, Artificial Sequence
  Description of Artificial Sequence: Synthetic peptide
AISGSGGGTYNADSVKG

SEQ ID NO: 8473 - DNA, 51 bp, Artificial Sequence
  Description of Artificial Sequence: Synthetic oligonucleotide
gctattagtggtagtggtggtggcacatactacgcagactccgtgaaggcc

SEQ ID NO: 8474 - protein, 17 aa, Artificial Sequence
  Description of Artificial Sequence: Synthetic peptide
AISGSGGGTYYADSVKA

SEQ ID NO: 8475 - DNA, 51 bp, Artificial Sequence
  Description of Artificial Sequence: Synthetic oligonucleotide
gctattagtggtagtggtggtggcacatactacgcagactccgtgaagggc

SEQ ID NO: 8476 - protein, 17 aa, Artificial Sequence
  Description of Artificial Sequence: Synthetic peptide
AISGSGGGTYYADSVKG

SEQ ID NO: 8477 - DNA, 51 bp, Artificial Sequence; identical to SEQ ID NO: 8475
  Description of Artificial Sequence: Synthetic oligonucleotide

SEQ ID NO: 8478 - protein, 17 aa, Artificial Sequence
  Description of Artificial Sequence: Synthetic peptide
AISGSGGGTYYADSVKG

SEQ ID NO: 8479 - DNA, 51 bp, Artificial Sequence; identical to SEQ ID NO: 8461
  Description of Artificial Sequence: Synthetic oligonucleotide

SEQ ID NO: 8480 - protein, 17 aa, Artificial Sequence
  Description of Artificial Sequence: Synthetic peptide
AISGSGGGTYYADSVKG

SEQ ID NO: 8481 - DNA, 51 bp, Artificial Sequence; identical to SEQ ID NO: 8465
  Description of Artificial Sequence: Synthetic oligonucleotide

SEQ ID NO: 8482 - protein, 17 aa, Artificial Sequence
  Description of Artificial Sequence: Synthetic peptide
AISGSGGGTYYADSVKG

SEQ ID NO: 8483 - DNA, 51 bp, Artificial Sequence; identical to SEQ ID NO: 8465
  Description of Artificial Sequence: Synthetic oligonucleotide

SEQ ID NO: 8484 - protein, 17 aa, Artificial Sequence
  Description of Artificial Sequence: Synthetic peptide
AISGSGGGTYYADSVKG

SEQ ID NO: 8485 - DNA, 51 bp, Artificial Sequence; identical to SEQ ID NO: 8465
  Description of Artificial Sequence: Synthetic oligonucleotide

SEQ ID NO: 8486 - protein, 17 aa, Artificial Sequence
  Description of Artificial Sequence: Synthetic peptide
AISGSGGGTYYADSVKG

SEQ ID NO: 8487 - DNA, 51 bp, Artificial Sequence
  Description of Artificial Sequence: Synthetic oligonucleotide
actattagtggtagtggtggtggcacatactacgcagactccgtgaagggc

SEQ ID NO: 8488 - protein, 17 aa, Artificial Sequence
  Description of Artificial Sequence: Synthetic peptide
TISGSGGGTYYADSVKG

SEQ ID NO: 8489 - DNA, 51 bp, Artificial Sequence; identical to SEQ ID NO: 8463
  Description of Artificial Sequence: Synthetic oligonucleotide

SEQ ID NO: 8490 - protein, 17 aa, Artificial Sequence
  Description of Artificial Sequence: Synthetic peptide
TISGSGGGTYYADSVKG

SEQ ID NO: 8491 - DNA, 51 bp, Artificial Sequence
  Description of Artificial Sequence: Synthetic oligonucleotide
gctattagtggtagtggtggtggcacatactacgcagactccgggaagggc

SEQ ID NO: 8492 - protein, 17 aa, Artificial Sequence
  Description of Artificial Sequence: Synthetic peptide
AISGSGGGTYYADSGKG

SEQ ID NO: 8493 - DNA, 51 bp, Artificial Sequence; identical to SEQ ID NO: 8487
  Description of Artificial Sequence: Synthetic oligonucleotide

SEQ ID NO: 8494 - protein, 17 aa, Artificial Sequence
  Description of Artificial Sequence: Synthetic peptide
TISGSGGGTYYADSVKG

SEQ ID NO: 8495 - DNA, 51 bp, Artificial Sequence; identical to SEQ ID NO: 8465
  Description of Artificial Sequence: Synthetic oligonucleotide

SEQ ID NO: 8496 - protein, 17 aa, Artificial Sequence
  Description of Artificial Sequence: Synthetic peptide
AISGSGGGTYYADSVKG

SEQ ID NO: 8497 - DNA, 51 bp, Artificial Sequence; identical to SEQ ID NO: 8487
  Description of Artificial Sequence: Synthetic oligonucleotide

SEQ ID NO: 8498 - protein, 17 aa, Artificial Sequence
  Description of Artificial Sequence: Synthetic peptide
TISGSGGGTYYADSVKG

SEQ ID NO: 8499 - DNA, 51 bp, Artificial Sequence; identical to SEQ ID NO: 8461
  Description of Artificial Sequence: Synthetic oligonucleotide

SEQ ID NO: 8500 - protein, 17 aa, Artificial Sequence
  Description of Artificial Sequence: Synthetic peptide
AISGSGGGTYYADSVKG

SEQ ID NO: 8501 - DNA, 51 bp, Artificial Sequence; identical to SEQ ID NO: 8475
  Description of Artificial Sequence: Synthetic oligonucleotide

SEQ ID NO: 8502 - protein, 17 aa, Artificial Sequence
  Description of Artificial Sequence: Synthetic peptide
AISGSGGGTYYADSVKG

SEQ ID NO: 8503 - DNA, 51 bp, Artificial Sequence; identical to SEQ ID NO: 8475
  Description of Artificial Sequence: Synthetic oligonucleotide

SEQ ID NO: 8504 - protein, 17 aa, Artificial Sequence
  Description of Artificial Sequence: Synthetic peptide
AISGSGGGTYYADSVKG

SEQ ID NO: 8505 - DNA, 51 bp, Artificial Sequence; identical to SEQ ID NO: 8465
  Description of Artificial Sequence: Synthetic oligonucleotide

SEQ ID NO: 8506 - protein, 17 aa, Artificial Sequence
  Description of Artificial Sequence: Synthetic peptide
AISGSGGGTYYADSVKG

SEQ ID NO: 8507 - DNA, 51 bp, Artificial Sequence; identical to SEQ ID NO: 8473
  Description of Artificial Sequence: Synthetic oligonucleotide

SEQ ID NO: 8508 - protein, 17 aa, Artificial Sequence
  Description of Artificial Sequence: Synthetic peptide
AISGSGGGTYYADSVKA

SEQ ID NO: 8509 - DNA, 51 bp, Artificial Sequence; identical to SEQ ID NO: 8465
  Description of Artificial Sequence: Synthetic oligonucleotide

SEQ ID NO: 8510 - protein, 17 aa, Artificial Sequence
  Description of Artificial Sequence: Synthetic peptide
AISGSGGGTYYADSVKG

SEQ ID NO: 8511 - DNA, 51 bp, Artificial Sequence; identical to SEQ ID NO: 8475
  Description of Artificial Sequence: Synthetic oligonucleotide

SEQ ID NO: 8512 - protein, 17 aa, Artificial Sequence
  Description of Artificial Sequence: Synthetic peptide
AISGSGGGTYYADSVKG

SEQ ID NO: 8513 - DNA, 51 bp, Artificial Sequence; identical to SEQ ID NO: 8487
  Description of Artificial Sequence: Synthetic oligonucleotide

SEQ ID NO: 8514 - protein, 17 aa, Artificial Sequence
  Description of Artificial Sequence: Synthetic peptide
TISGSGGGTYYADSVKG

SEQ ID NO: 8515 - DNA, 51 bp, Artificial Sequence; identical to SEQ ID NO: 8465
  Description of Artificial Sequence: Synthetic oligonucleotide

SEQ ID NO: 8516 - protein, 17 aa, Artificial Sequence
  Description of Artificial Sequence: Synthetic peptide
AISGSGGGTYYADSVKG

SEQ ID NO: 8517 - DNA, 51 bp, Artificial Sequence; identical to SEQ ID NO: 8461
  Description of Artificial Sequence: Synthetic oligonucleotide

SEQ ID NO: 8518 - protein, 17 aa, Artificial Sequence
  Description of Artificial Sequence: Synthetic peptide
AISGSGGGTYYADSVKG

SEQ ID NO: 8519 - DNA, 51 bp, Artificial Sequence; identical to SEQ ID NO: 8467
  Description of Artificial Sequence: Synthetic oligonucleotide

SEQ ID NO: 8520 - protein, 17 aa, Artificial Sequence
  Description of Artificial Sequence: Synthetic peptide
AISGSGGGTYNADSVKG

SEQ ID NO: 8521 - DNA, 51 bp, Artificial Sequence; identical to SEQ ID NO: 8465
  Description of Artificial Sequence: Synthetic oligonucleotide

SEQ ID NO: 8522 - protein, 17 aa, Artificial Sequence
  Description of Artificial Sequence: Synthetic peptide
AISGSGGGTYYADSVKG

SEQ ID NO: 8523 - DNA, 51 bp, Artificial Sequence; identical to SEQ ID NO: 8473
  Description of Artificial Sequence: Synthetic oligonucleotide

SEQ ID NO: 8524 - protein, 17 aa, Artificial Sequence
  Description of Artificial Sequence: Synthetic peptide
AISGSGGGTYYADSVKA

SEQ ID NO: 8525 - DNA, 51 bp, Artificial Sequence; identical to SEQ ID NO: 8467
  Description of Artificial Sequence: Synthetic oligonucleotide

SEQ ID NO: 8526 - protein, 17 aa, Artificial Sequence
  Description of Artificial Sequence: Synthetic peptide
AISGSGGGTYNADSVKG

SEQ ID NO: 8527 - DNA, 51 bp, Artificial Sequence; identical to SEQ ID NO: 8359
  Description of Artificial Sequence: Synthetic oligonucleotide

SEQ ID NO: 8528 - protein, 17 aa, Artificial Sequence
  Description of Artificial Sequence: Synthetic peptide
VISYDGSNKYYADSVKG

SEQ ID NO: 8529 - DNA, 51 bp, Artificial Sequence
  Description of Artificial Sequence: Synthetic oligonucleotide
tggatcagcggttacaatggtgacacaaactatgcacagaagctccagggc

SEQ ID NO: 8530 - protein, 17 aa, Artificial Sequence
  Description of Artificial Sequence: Synthetic peptide
WISGYNGDTNYAQKLQG

SEQ ID NO: 8531 - DNA, 51 bp, Artificial Sequence; identical to SEQ ID NO: 8529
  Description of Artificial Sequence: Synthetic oligonucleotide

SEQ ID NO: 8532 - protein, 17 aa, Artificial Sequence
  Description of Artificial Sequence: Synthetic peptide
WISGYNGDTNYAQKLQG

SEQ ID NO: 8533 - DNA, 51 bp, Artificial Sequence
  Description of Artificial Sequence: Synthetic oligonucleotide
tacattagtaaaagtggtagtaccatatactacgcagactctgtgaagggc

SEQ ID NO: 8534 - protein, 17 aa, Artificial Sequence
  Description of Artificial Sequence: Synthetic peptide
YISKSGSTIYYADSVKG

SEQ ID NO: 8535 - DNA, 51 bp, Artificial Sequence; identical to SEQ ID NO: 8465
  Description of Artificial Sequence: Synthetic oligonucleotide

SEQ ID NO: 8536 - protein, 17 aa, Artificial Sequence
  Description of Artificial Sequence: Synthetic peptide
AISGSGGGTYYADSVKG

SEQ ID NO: 8537 - DNA, 51 bp, Artificial Sequence; identical to SEQ ID NO: 8473
  Description of Artificial Sequence: Synthetic oligonucleotide

SEQ ID NO: 8538 - protein, 17 aa, Artificial Sequence
  Description of Artificial Sequence: Synthetic peptide
AISGSGGGTYYADSVKA

SEQ ID NO: 8539 - DNA, 51 bp, Artificial Sequence; identical to SEQ ID NO: 8465
  Description of Artificial Sequence: Synthetic oligonucleotide

SEQ ID NO: 8540 - protein, 17 aa, Artificial Sequence
  Description of Artificial Sequence: Synthetic peptide
AISGSGGGTYYADSVKG

SEQ ID NO: 8541 - DNA, 51 bp, Artificial Sequence; identical to SEQ ID NO: 8475
  Description of Artificial Sequence: Synthetic oligonucleotide

SEQ ID NO: 8542 - protein, 17 aa, Artificial Sequence
  Description of Artificial Sequence: Synthetic peptide
AISGSGGGTYYADSVKG

SEQ ID NO: 8543 - DNA, 51 bp, Artificial Sequence; identical to SEQ ID NO: 8467
  Description of Artificial Sequence: Synthetic oligonucleotide

SEQ ID NO: 8544 - protein, 17 aa, Artificial Sequence
  Description of Artificial Sequence: Synthetic peptide
AISGSGGGTYNADSVKG

SEQ ID NO: 8545 - DNA, 51 bp, Artificial Sequence; identical to SEQ ID NO: 8463
  Description of Artificial Sequence: Synthetic oligonucleotide

SEQ ID NO: 8546 - protein, 17 aa, Artificial Sequence
  Description of Artificial Sequence: Synthetic peptide
TISGSGGGTYYADSVKG

SEQ ID NO: 8547 - DNA, 51 bp, Artificial Sequence; identical to SEQ ID NO: 8491
  Description of Artificial Sequence: Synthetic oligonucleotide

SEQ ID NO: 8548 - protein, 17 aa, Artificial Sequence
  Description of Artificial Sequence: Synthetic peptide
AISGSGGGTYYADSGKG

SEQ ID NO: 8549 - DNA, 51 bp, Artificial Sequence
  Description of Artificial Sequence: Synthetic oligonucleotide
tctattagtggtagcggtggtggcacatactacgcagcctccgtgaagggc

SEQ ID NO: 8550 - protein, 17 aa, Artificial Sequence
  Description of Artificial Sequence: Synthetic peptide
SISGSGGGTYYAASVKG

SEQ ID NO: 8551 - DNA, 51 bp, Artificial Sequence; identical to SEQ ID NO: 8465
  Description of Artificial Sequence: Synthetic oligonucleotide

SEQ ID NO: 8552 - protein, 17 aa, Artificial Sequence
  Description of Artificial Sequence: Synthetic peptide
AISGSGGGTYYADSVKG

SEQ ID NO: 8553 - DNA, 51 bp, Artificial Sequence; identical to SEQ ID NO: 8463
  Description of Artificial Sequence: Synthetic oligonucleotide

SEQ ID NO: 8554 - protein, 17 aa, Artificial Sequence
  Description of Artificial Sequence: Synthetic peptide
TISGSGGGTYYADSVKG

SEQ ID NO: 8555 - DNA, 51 bp, Artificial Sequence
  Description of Artificial Sequence: Synthetic oligonucleotide
tctattagtggtagtggtggtggcacatactacgcagcctccgtgaagggc

SEQ ID NO: 8556 - protein, 17 aa, Artificial Sequence
  Description of Artificial Sequence: Synthetic peptide
SISGSGGGTYYAASVKG

SEQ ID NO: 8557 - DNA, 51 bp, Artificial Sequence; identical to SEQ ID NO: 8467
  Description of Artificial Sequence: Synthetic oligonucleotide

SEQ ID NO: 8558 - protein, 17 aa, Artificial Sequence
  Description of Artificial Sequence: Synthetic peptide
AISGSGGGTYNADSVKG

SEQ ID NO: 8559 - DNA, 48 bp, Artificial Sequence; identical to SEQ ID NO: 8371
  Description of Artificial Sequence: Synthetic oligonucleotide

SEQ ID NO: 8560 - protein, 16 aa, Artificial Sequence
  Description of Artificial Sequence: Synthetic peptide
SIYYSGSTYYNPSLKS

SEQ ID NO: 8561 - DNA, 48 bp, Artificial Sequence; identical to SEQ ID NO: 8371
  Description of Artificial Sequence: Synthetic oligonucleotide

SEQ ID NO: 8562 - protein, 16 aa, Artificial Sequence
  Description of Artificial Sequence: Synthetic peptide
SIYYSGSTYYNPSLKS

SEQ ID NO: 8563 - DNA, 48 bp, Artificial Sequence
  Description of Artificial Sequence: Synthetic oligonucleotide
ctcatttattggaatgatgataagcgctacaacccatctctgcagagt

SEQ ID NO: 8564 - protein, 16 aa, Artificial Sequence
  Description of Artificial Sequence: Synthetic peptide
LIYWNDDKRYNPSLQS

SEQ ID NO: 8565 - DNA, 48 bp, Artificial Sequence; identical to SEQ ID NO: 8395
  Description of Artificial Sequence: Synthetic oligonucleotide

SEQ ID NO: 8566 - protein, 16 aa, Artificial Sequence
  Description of Artificial Sequence: Synthetic peptide
LIYWNDDKRYSPSLQS

SEQ ID NO: 8567 - DNA, 48 bp, Artificial Sequence; identical to SEQ ID NO: 8395
  Description of Artificial Sequence: Synthetic oligonucleotide

SEQ ID NO: 8568 - protein, 16 aa, Artificial Sequence
  Description of Artificial Sequence: Synthetic peptide
LIYWNDDKRYSPSLQS

SEQ ID NO: 8569 - DNA, 48 bp, Artificial Sequence; identical to SEQ ID NO: 8395
  Description of Artificial Sequence: Synthetic oligonucleotide

SEQ ID NO: 8570 - protein, 16 aa, Artificial Sequence
  Description of Artificial Sequence: Synthetic peptide
LIYWNDDKRYSPSLQS

SEQ ID NO: 8571 - DNA, 48 bp, Artificial Sequence; identical to SEQ ID NO: 8395
  Description of Artificial Sequence: Synthetic oligonucleotide

SEQ ID NO: 8572 - protein, 16 aa, Artificial Sequence
  Description of Artificial Sequence: Synthetic peptide
LIYWNDDKRYSPSLQS

SEQ ID NO: 8573 - DNA, 48 bp, Artificial Sequence; identical to SEQ ID NO: 8395
  Description of Artificial Sequence: Synthetic oligonucleotide

SEQ ID NO: 8574 - protein, 16 aa, Artificial Sequence
  Description of Artificial Sequence: Synthetic peptide
LIYWNDDKRYSPSLQS

SEQ ID NO: 8575 - DNA, 51 bp, Artificial Sequence
  Description of Artificial Sequence: Synthetic oligonucleotide
actattagtattagtggtggtagcacaaactacgcagactccgtgaagggc

SEQ ID NO: 8576 - protein, 17 aa, Artificial Sequence
  Description of Artificial Sequence: Synthetic peptide
TISISGGSTNYADSVKG

SEQ ID NO: 8577 - DNA, 57 bp, Artificial Sequence; identical to SEQ ID NO: 8417
  Description of Artificial Sequence: Synthetic oligonucleotide

SEQ ID NO: 8578 - protein, 19 aa, Artificial Sequence
  Description of Artificial Sequence: Synthetic peptide
RIKGNTYGGTTDYAAPVKG

SEQ ID NO: 8579 - DNA, 57 bp, Artificial Sequence
  Description of Artificial Sequence: Synthetic oligonucleotide
cgtattaaaagcaaaacttatggtgggacaacagactacgctgcacccgtgaaaggc

SEQ ID NO: 8580 - protein, 19 aa, Artificial Sequence
  Description of Artificial Sequence: Synthetic peptide
RIKSKTYGGTTDYAAPVKG

SEQ ID NO: 8581 - DNA, 57 bp, Artificial Sequence; identical to SEQ ID NO: 8417
  Description of Artificial Sequence: Synthetic oligonucleotide

SEQ ID NO: 8582 - protein, 19 aa, Artificial Sequence
  Description of Artificial Sequence: Synthetic peptide
RIKGNTYGGTTDYAAPVKG

SEQ ID NO: 8583 - DNA, 57 bp, Artificial Sequence; identical to SEQ ID NO: 8417
  Description of Artificial Sequence: Synthetic oligonucleotide

SEQ ID NO: 8584 - protein, 19 aa, Artificial Sequence
  Description of Artificial Sequence: Synthetic peptide
RIKGNTYGGTTDYAAPVKG

SEQ ID NO: 8585 - DNA, 57 bp, Artificial Sequence; identical to SEQ ID NO: 8417
  Description of Artificial Sequence: Synthetic oligonucleotide

SEQ ID NO: 8586 - protein, 19 aa, Artificial Sequence
  Description of Artificial Sequence: Synthetic peptide
RIKGNTYGGTTDYAAPVKG

SEQ ID NO: 8587 - DNA, 57 bp, Artificial Sequence; identical to SEQ ID NO: 8417
  Description of Artificial Sequence: Synthetic oligonucleotide

SEQ ID NO: 8588 - protein, 19 aa, Artificial Sequence
  Description of Artificial Sequence: Synthetic peptide
RIKGNTYGGTTDYAAPVKG

SEQ ID NO: 8589 - DNA, 48 bp, Artificial Sequence
  Description of Artificial Sequence: Synthetic oligonucleotide
tacatctcttacagtgggatcaccaactacaacccctccctcaagagt

SEQ ID NO: 8590 - protein, 16 aa, Artificial Sequence
  Description of Artificial Sequence: Synthetic peptide
YISYSGITNYNPSLKS

SEQ ID NO: 8591 - DNA, 48 bp, Artificial Sequence; identical to SEQ ID NO: 8409
  Description of Artificial Sequence: Synthetic oligonucleotide

SEQ ID NO: 8592 - protein, 16 aa, Artificial Sequence
  Description of Artificial Sequence: Synthetic peptide
YISYSGSTFYNPSLKS

SEQ ID NO: 8593 - DNA, 57 bp, Artificial Sequence; identical to SEQ ID NO: 8417
  Description of Artificial Sequence: Synthetic oligonucleotide

SEQ ID NO: 8594 - protein, 19 aa, Artificial Sequence
  Description of Artificial Sequence: Synthetic peptide
RIKGNTYGGTTDYAAPVKG

SEQ ID NO: 8595 - DNA, 57 bp, Artificial Sequence; identical to SEQ ID NO: 8417
  Description of Artificial Sequence: Synthetic oligonucleotide

SEQ ID NO: 8596 - protein, 19 aa, Artificial Sequence
  Description of Artificial Sequence: Synthetic peptide
RIKGNTYGGTTDYAAPVKG

SEQ ID NO: 8597 - DNA, 57 bp, Artificial Sequence; identical to SEQ ID NO: 8417
  Description of Artificial Sequence: Synthetic oligonucleotide

SEQ ID NO: 8598 - protein, 19 aa, Artificial Sequence
  Description of Artificial Sequence: Synthetic peptide
RIKGNTYGGTTDYAAPVKG

SEQ ID NO: 8599 - DNA, 48 bp, Artificial Sequence; identical to SEQ ID NO: 8425
  Description of Artificial Sequence: Synthetic oligonucleotide

SEQ ID NO: 8600 - protein, 16 aa, Artificial Sequence
  Description of Artificial Sequence: Synthetic peptide
YISHSGSTYYNPSLKS

SEQ ID NO: 8601 - DNA, 48 bp, Artificial Sequence; identical to SEQ ID NO: 8409
  Description of Artificial Sequence: Synthetic oligonucleotide

SEQ ID NO: 8602 - protein, 16 aa, Artificial Sequence
  Description of Artificial Sequence: Synthetic peptide
YISYSGSTFYNPSLKS

SEQ ID NO: 8603 - DNA, 48 bp, Artificial Sequence; identical to SEQ ID NO: 8425
  Description of Artificial Sequence: Synthetic oligonucleotide

SEQ ID NO: 8604 - protein, 16 aa, Artificial Sequence
  Description of Artificial Sequence: Synthetic peptide
YISHSGSTYYNPSLKS

SEQ ID NO: 8605 - DNA, 57 bp, Artificial Sequence; identical to SEQ ID NO: 8417
  Description of Artificial Sequence: Synthetic oligonucleotide

SEQ ID NO: 8606 - protein, 19 aa, Artificial Sequence
  Description of Artificial Sequence: Synthetic peptide
RIKGNTYGGTTDYAAPVKG

SEQ ID NO: 8607 - protein, 17 aa, Artificial Sequence
  Description of Artificial Sequence: Synthetic peptide
AISGSGGGTYYAASVKG

SEQ ID NO: 8608 - protein, 17 aa, Artificial Sequence
  Description of Artificial Sequence: Synthetic peptide
AISGSGGGTYYAASVKG

SEQ ID NO: 8609 - protein, 17 aa, Artificial Sequence
  Description of Artificial Sequence: Synthetic peptide
VISYDAETVKYAESVKG

SEQ ID NO: 8610 - protein, 17 aa, Artificial Sequence
  Description of Artificial Sequence: Synthetic peptide
YISKSSYTVTYADAVKG

SEQ ID NO: 8611 - protein, 16 aa, Artificial Sequence
  Description of Artificial Sequence: Synthetic peptide
YISYSGITNYNPSLKS

SEQ ID NO: 8612 - protein, 16 aa, Artificial Sequence
  Description of Artificial Sequence: Synthetic peptide
SIYYSGSTYYNPSLKS

SEQ ID NO: 8613 - protein, 17 aa, Artificial Sequence
  Description of Artificial Sequence: Synthetic peptide
SISGSGGGTYYAASVKG

SEQ ID NO: 8614 - protein, 17 aa, Artificial Sequence
  Description of Artificial Sequence: Synthetic peptide
TISGSGGGTYYADSVKG

SEQ ID NO: 8615 - protein, 17 aa, Artificial Sequence
  Description of Artificial Sequence: Synthetic peptide
TISGSGGGTYYAASVKG

SEQ ID NO: 8616 - protein, 17 aa, Artificial Sequence
  Description of Artificial Sequence: Synthetic peptide
AISGSGGGTYNAASVKG

SEQ ID NO: 8617 - protein, 17 aa, Artificial Sequence
  Description of Artificial Sequence: Synthetic peptide
AISGSGGGTYYADSVKG

SEQ ID NO: 8618 - protein, 17 aa, Artificial Sequence
  Description of Artificial Sequence: Synthetic peptide
AISGSGGGTYYAASVKG

SEQ ID NO: 8619 - protein, 17 aa, Artificial Sequence
  Description of Artificial Sequence: Synthetic peptide
AISGSGGGTYYADSVKG

SEQ ID NO: 8620 - protein, 17 aa, Artificial Sequence
  Description of Artificial Sequence: Synthetic peptide
AISGSGGGTYYAASVKG

SEQ ID NO: 8621 - protein, 19 aa, Artificial Sequence
  Description of Artificial Sequence: Synthetic peptide
RIKSKTYGGTTDYAAPVKG

SEQ ID NO: 8622 - protein, 16 aa, Artificial Sequence
  Description of Artificial Sequence: Synthetic peptide
LIYWNDDKRYSPSLQS

SEQ ID NO: 8623 - protein, 16 aa, Artificial Sequence
  Description of Artificial Sequence: Synthetic peptide
GIHIYDDKRYSPSLQS

SEQ ID NO: 8624 - protein, 16 aa, Artificial Sequence
  Description of Artificial Sequence: Synthetic peptide
LIYWNDDKRYSPSLQS

SEQ ID NO: 8625 - protein, 16 aa, Artificial Sequence
  Description of Artificial Sequence: Synthetic peptide
LIYWNDDKRYSPSLQS

SEQ ID NO: 8626 - protein, 19 aa, Artificial Sequence
  Description of Artificial Sequence: Synthetic peptide
RIRSRSYGGTTDYAAPVKG

SEQ ID NO: 8627 - protein, 19 aa, Artificial Sequence
  Description of Artificial Sequence: Synthetic peptide
RIKSKTYGGTTDYAAPVKG

SEQ ID NO: 8628 - protein, 19 aa, Artificial Sequence
  Description of Artificial Sequence: Synthetic peptide
RITSSRYGGTTDYAAPVKG

SEQ ID NO: 8629 - protein, 19 aa, Artificial Sequence
  Description of Artificial Sequence: Synthetic peptide
RILNNAYGGTTDYAAPVKG

SEQ ID NO: 8630 - protein, 17 aa, Artificial Sequence
  Description of Artificial Sequence: Synthetic peptide
AISGSGGGTYNADSVKG

SEQ ID NO: 8631 - protein, 17 aa, Artificial Sequence
  Description of Artificial Sequence: Synthetic peptide
AISGSGGGTYNAASVKG

SEQ ID NO: 8632 - protein, 19 aa, Artificial Sequence
  Description of Artificial Sequence: Synthetic peptide
RITSGIYGGTTDYAAPVKG

SEQ ID NO: 8633 - protein, 19 aa, Artificial Sequence
  Description of Artificial Sequence: Synthetic peptide
RIRSRPYGGTTDYAAPVKG

SEQ ID NO: 8634 - protein, 17 aa, Artificial Sequence
  Description of Artificial Sequence: Synthetic peptide
VISYDASNKYYAESVKG

SEQ ID NO: 8635 - DNA, 27 bp, Artificial Sequence
  Description of Artificial Sequence: Synthetic oligonucleotide
cagcaatattatagctatccgtacacg

SEQ ID NO: 8636 - protein, 9 aa, Artificial Sequence
  Description of Artificial Sequence: Synthetic peptide
QQYYSYPYT

SEQ ID NO: 8637 - DNA, 27 bp, Artificial Sequence
  Description of Artificial Sequence: Synthetic oligonucleotide
catcagtggagtagttacccacctacg

SEQ ID NO: 8638 - protein, 9 aa, Artificial Sequence
  Description of Artificial Sequence: Synthetic peptide
HQWSSYPPT

SEQ ID NO: 8639 - DNA, 27 bp, Artificial Sequence
  Description of Artificial Sequence: Synthetic oligonucleotide
caacatcattatggtactccgctcacg

SEQ ID NO: 8640 - protein, 9 aa, Artificial Sequence
  Description of Artificial Sequence: Synthetic peptide
QHHYGTPLT

SEQ ID NO: 8641 - DNA, 27 bp, Artificial Sequence
  Description of Artificial Sequence: Synthetic oligonucleotide
atgcaagctctacaaactcctcccacc

SEQ ID NO: 8642 - protein, 9 aa, Artificial Sequence
  Description of Artificial Sequence: Synthetic peptide
MQALQTPPT

SEQ ID NO: 8643 - DNA, 27 bp, Artificial Sequence
  Description of Artificial Sequence: Synthetic oligonucleotide
atgcaacctctacaaactcctcccact

SEQ ID NO: 8644 - protein, 9 aa, Artificial Sequence
  Description of Artificial Sequence: Synthetic peptide
MQPLQTPPT

SEQ ID NO: 8645 - DNA, 27 bp, Artificial Sequence
  Description of Artificial Sequence: Synthetic oligonucleotide
atgcaaggtacacactggcctcggacg

SEQ ID NO: 8646 - protein, 9 aa, Artificial Sequence
  Description of Artificial Sequence: Synthetic peptide
MQGTHWPRT

SEQ ID NO: 8647 - DNA, 27 bp, Artificial Sequence
  Description of Artificial Sequence: Synthetic oligonucleotide
cagcagtatggtaggtcactattcact

SEQ ID NO: 8648 - protein, 9 aa, Artificial Sequence
  Description of Artificial Sequence: Synthetic peptide
QQYGRSLFT

SEQ ID NO: 8649 - DNA, 27 bp, Artificial Sequence
  Description of Artificial Sequence: Synthetic oligonucleotide
cagcagtatggtagctcaccgctcact

SEQ ID NO: 8650 - protein, 9 aa, Artificial Sequence
  Description of Artificial Sequence: Synthetic peptide
QQYGSSPLT

SEQ ID NO: 8651 - DNA, 27 bp, Artificial Sequence
  Description of Artificial Sequence: Synthetic oligonucleotide
atgcaagctctacaaactccattcact

SEQ ID NO: 8652 - protein, 9 aa, Artificial Sequence
  Description of Artificial Sequence: Synthetic peptide
MQALQTPFT

SEQ ID NO: 8653 - DNA, 27 bp, Artificial Sequence
  Description of Artificial Sequence: Synthetic oligonucleotide
caacaggctaacagtttccctccgacg

SEQ ID NO: 8654 - protein, 9 aa, Artificial Sequence
  Description of Artificial Sequence: Synthetic peptide
QQANSFPPT

SEQ ID NO: 8655 - DNA, 27 bp, Artificial Sequence
  Description of Artificial Sequence: Synthetic oligonucleotide
atgcaagctctacaaactcctctcact

SEQ ID NO: 8656 - protein, 9 aa, Artificial Sequence
  Description of Artificial Sequence: Synthetic peptide
MQALQTPLT

SEQ ID NO: 8657 - DNA, 27 bp, Artificial Sequence
  Description of Artificial Sequence: Synthetic oligonucleotide
cagcagtatggtagctcaccgctcact

SEQ ID NO: 8658 - protein, 9 aa, Artificial Sequence
  Description of Artificial Sequence: Synthetic peptide
QQYGSSPLT

SEQ ID NO: 8659 - DNA, 27 bp, Artificial Sequence
  Description of Artificial Sequence: Synthetic oligonucleotide
atgcaaggtacacactggccgctcact

SEQ ID NO: 8660 - protein, 9 aa, Artificial Sequence
  Description of Artificial Sequence: Synthetic peptide
MQGTHWPLT

SEQ ID NO: 8661 - DNA, 27 bp, Artificial Sequence
  Description of Artificial Sequence: Synthetic oligonucleotide
atgcaagctctacaaactccgtgcagt

SEQ ID NO: 8662 - protein, 9 aa, Artificial Sequence
  Description of Artificial Sequence: Synthetic peptide
MQALQTPCS

SEQ ID NO: 8663 - DNA, 27 bp, Artificial Sequence
  Description of Artificial Sequence: Synthetic oligonucleotide
atgcaagctctacaaactcctccgacg

SEQ ID NO: 8664 - protein, 9 aa, Artificial Sequence
  Description of Artificial Sequence: Synthetic peptide
MQALQTPPT

SEQ ID NO: 8665 - DNA, 27 bp, Artificial Sequence
  Description of Artificial Sequence: Synthetic oligonucleotide
atgcaagctctacaaactcctccgacg

SEQ ID NO: 8666 - protein, 9 aa, Artificial Sequence
  Description of Artificial Sequence: Synthetic peptide
MQALQTPPT

SEQ ID NO: 8667 - DNA, 27 bp, Artificial Sequence
  Description of Artificial Sequence: Synthetic oligonucleotide
caacagagttacagaacccctccgacg

SEQ ID NO: 8668 - protein, 9 aa, Artificial Sequence
  Description of Artificial Sequence: Synthetic peptide
QQSYRTPPT

SEQ ID NO: 8669 - DNA, 27 bp, Artificial Sequence
  Description of Artificial Sequence: Synthetic oligonucleotide
atgcaagctctacaaactccattcact

SEQ ID NO: 8670 - protein, 9 aa, Artificial Sequence
  Description of Artificial Sequence: Synthetic peptide
MQALQTPFT

SEQ ID NO: 8671 - DNA, 27 bp, Artificial Sequence
  Description of Artificial Sequence: Synthetic oligonucleotide
atgcaagctctacaaactccgatcacc

SEQ ID NO: 8672 - protein, 9 aa, Artificial Sequence
  Description of Artificial Sequence: Synthetic peptide
MQALQTPIT

SEQ ID NO: 8673 - DNA, 27 bp, Artificial Sequence
  Description of Artificial Sequence: Synthetic oligonucleotide
atgcaaggtacacactggccattcact

SEQ ID NO: 8674 - protein, 9 aa, Artificial Sequence
  Description of Artificial Sequence: Synthetic peptide
MQGTHWPFT

SEQ ID NO: 8675 - DNA, 27 bp, Artificial Sequence
  Description of Artificial Sequence: Synthetic oligonucleotide
atgcaagctctacaaactccgtggacg

SEQ ID NO: 8676 - protein, 9 aa, Artificial Sequence
  Description of Artificial Sequence: Synthetic peptide
MQALQTPWT

SEQ ID NO: 8677 - DNA, 27 bp, Artificial Sequence
  Description of Artificial Sequence: Synthetic oligonucleotide
atgcaaagtatacagcttccgtggacg

SEQ ID NO: 8678 - protein, 9 aa, Artificial Sequence
  Description of Artificial Sequence: Synthetic peptide
MQSIQLPWT

SEQ ID NO: 8679 - DNA, 27 bp, Artificial Sequence
  Description of Artificial Sequence: Synthetic oligonucleotide
atgcaaggtacacactggcctctcact

SEQ ID NO: 8680 - protein, 9 aa, Artificial Sequence
  Description of Artificial Sequence: Synthetic peptide
MQGTHWPLT

SEQ ID NO: 8681 - DNA, 27 bp, Artificial Sequence
  Description of Artificial Sequence: Synthetic oligonucleotide
atgcaagctctacaaactccgctcact

SEQ ID NO: 8682 - protein, 9 aa, Artificial Sequence
  Description of Artificial Sequence: Synthetic peptide
MQALQTPLT

SEQ ID NO: 8683 - DNA, 27 bp, Artificial Sequence
  Description of Artificial Sequence: Synthetic oligonucleotide
caacagagttacagtacccctccgacg

SEQ ID NO: 8684 - protein, 9 aa, Artificial Sequence
  Description of Artificial Sequence: Synthetic peptide
QQSYSTPPT

SEQ ID NO: 8685 - DNA, 27 bp, Artificial Sequence
  Description of Artificial Sequence: Synthetic oligonucleotide
caacagagttacagtaccccattcact

SEQ ID NO: 8686 - protein, 9 aa, Artificial Sequence
  Description of Artificial Sequence: Synthetic peptide
QQSYSTPFT

SEQ ID NO: 8687 - DNA, 27 bp, Artificial Sequence
  Description of Artificial Sequence: Synthetic oligonucleotide
atgcaaggtacacactggccattcact

SEQ ID NO: 8688 - protein, 9 aa, Artificial Sequence
  Description of Artificial Sequence: Synthetic peptide
MQGTHWPFT

SEQ ID NO: 8689 - DNA, 27 bp, Artificial Sequence
  Description of Artificial Sequence: Synthetic oligonucleotide
atgcaagctctacaaactccgatcacc

SEQ ID NO: 8690 - protein, 9 aa, Artificial Sequence
  Description of Artificial Sequence: Synthetic peptide
MQALQTPIT

SEQ ID NO: 8691 - DNA, 27 bp, Artificial Sequence
  Description of Artificial Sequence: Synthetic oligonucleotide
atgcaagctctacaaactcctccgacg

SEQ ID NO: 8692 - protein, 9 aa, Artificial Sequence
  Description of Artificial Sequence: Synthetic peptide
MQALQTPPT

SEQ ID NO: 8693 - DNA, 27 bp, Artificial Sequence
  Description of Artificial Sequence: Synthetic oligonucleotide
atgcaagctctacaaactccattcact

SEQ ID NO: 8694 - protein, 9 aa, Artificial Sequence
  Description of Artificial Sequence: Synthetic peptide
MQALQTPFT

SEQ ID NO: 8695 - DNA, 27 bp, Artificial Sequence
  Description of Artificial Sequence: Synthetic oligonucleotide
caacagagttacagtacccctccgacg

SEQ ID NO: 8696 - protein, 9 aa, Artificial Sequence
  Description of Artificial Sequence: Synthetic peptide
QQSYSTPPT

SEQ ID NO: 8697 - DNA, 24 bp, Artificial Sequence
  Description of Artificial Sequence: Synthetic oligonucleotide
atgcaagctctacaatctctcact

SEQ ID NO: 8698 - protein, 8 aa, Artificial Sequence
  Description of Artificial Sequence: Synthetic peptide
MQALQSLT

SEQ ID NO: 8699 - DNA, 27 bp, Artificial Sequence
  Description of Artificial Sequence: Synthetic oligonucleotide
atgcaggctctacaaactccgctcact

SEQ ID NO: 8700 - protein, 9 aa, Artificial Sequence
  Description of Artificial Sequence: Synthetic peptide
MQALQTPLT

SEQ ID NO: 8701 - DNA, 24 bp, Artificial Sequence
  Description of Artificial Sequence: Synthetic oligonucleotide
atgcaagctctacaaactcctcat

SEQ ID NO: 8702 - protein, 8 aa, Artificial Sequence
  Description of Artificial Sequence: Synthetic peptide
MQALQTPH

SEQ ID NO: 8703 - DNA, 27 bp, Artificial Sequence
  Description of Artificial Sequence: Synthetic oligonucleotide
atgcaagctctacaaactccgatcacc

SEQ ID NO: 8704 - protein, 9 aa, Artificial Sequence
  Description of Artificial Sequence: Synthetic peptide
MQALQTPIT

SEQ ID NO: 8705 - DNA, 30 bp, Artificial Sequence
  Description of Artificial Sequence: Synthetic oligonucleotide
agctcatatacaagcagcagcactctggta

SEQ ID NO: 8706 - protein, 10 aa, Artificial Sequence
  Description of Artificial Sequence: Synthetic peptide
SSYTSSSTLV

SEQ ID NO: 8707 - DNA, 27 bp, Artificial Sequence
  Description of Artificial Sequence: Synthetic oligonucleotide
cagcaatattatagtactccgtggacg

SEQ ID NO: 8708 - protein, 9 aa, Artificial Sequence
  Description of Artificial Sequence: Synthetic peptide
QQYYSTPWT

SEQ ID NO: 8709 - DNA, 27 bp, Artificial Sequence
  Description of Artificial Sequence: Synthetic oligonucleotide
cagcaatattatagtactccgtggacg

SEQ ID NO: 8710 - protein, 9 aa, Artificial Sequence
  Description of Artificial Sequence: Synthetic peptide
QQYYSTPWT

SEQ ID NO: 8711 - DNA, 24 bp, Artificial Sequence
  Description of Artificial Sequence: Synthetic oligonucleotide
cagcagtatggtagctcgctcact

SEQ ID NO: 8712 - protein, 8 aa, Artificial Sequence
  Description of Artificial Sequence: Synthetic peptide
QQYGSSLT

SEQ ID NO: 8713 - DNA, 33 bp, Artificial Sequence
  Description of Artificial Sequence: Synthetic oligonucleotide
gcagcatgggatgacagcctgagtggtgtggta

SEQ ID NO: 8714 - protein, 11 aa, Artificial Sequence
  Description of Artificial Sequence: Synthetic peptide
AAWDDSLSGVV

SEQ ID NO: 8715 - DNA, 27 bp, Artificial Sequence
  Description of Artificial Sequence: Synthetic oligonucleotide
caacagagttacagtatccctccgacg

SEQ ID NO: 8716 - protein, 9 aa, Artificial Sequence
  Description of Artificial Sequence: Synthetic peptide
QQSYSIPPT

SEQ ID NO: 8717 - DNA, 33 bp, Artificial Sequence
  Description of Artificial Sequence: Synthetic oligonucleotide
tcagcatgggacagcagcctcagtgcttgggtg

SEQ ID NO: 8718 - protein, 11 aa, Artificial Sequence
  Description of Artificial Sequence: Synthetic peptide
SAWDSSLSAWV

SEQ ID NO: 8719 - DNA, 33 bp, Artificial Sequence; identical to SEQ ID NO: 8717
  Description of Artificial Sequence: Synthetic oligonucleotide

SEQ ID NO: 8720 - protein, 11 aa, Artificial Sequence
  Description of Artificial Sequence: Synthetic peptide
SAWDSSLSAWV

SEQ ID NO: 8721 - DNA, 27 bp, Artificial Sequence
  Description of Artificial Sequence: Synthetic oligonucleotide
cagcaatattatagtactccgtggacg

SEQ ID NO: 8722 - protein, 9 aa, Artificial Sequence
  Description of Artificial Sequence: Synthetic peptide
QQYYSTPWT

SEQ ID NO: 8723 - DNA, 27 bp, Artificial Sequence
  Description of Artificial Sequence: Synthetic oligonucleotide
cagcaatattatagtactccgtggacg

SEQ ID NO: 8724 - protein, 9 aa, Artificial Sequence
  Description of Artificial Sequence: Synthetic peptide
QQYYSTPWT

SEQ ID NO: 8725 - DNA, 27 bp, Artificial Sequence
  Description of Artificial Sequence: Synthetic oligonucleotide
atgcaagctctacaaactcctcggacg

SEQ ID NO: 8726 - protein, 9 aa, Artificial Sequence
  Description of Artificial Sequence: Synthetic peptide
MQALQTPRT

SEQ ID NO: 8727 - DNA, 27 bp, Artificial Sequence
  Description of Artificial Sequence: Synthetic oligonucleotide
cagcagtatggtagctcaccattcact

SEQ ID NO: 8728 - protein, 9 aa, Artificial Sequence
  Description of Artificial Sequence: Synthetic peptide
QQYGSSPFT

SEQ ID NO: 8729 - DNA, 27 bp, Artificial Sequence
  Description of Artificial Sequence: Synthetic oligonucleotide
cagcaatattatagtactccgctcact

SEQ ID NO: 8730 - protein, 9 aa, Artificial Sequence
  Description of Artificial Sequence: Synthetic peptide
QQYYSTPLT

SEQ ID NO: 8731 - DNA, 27 bp, Artificial Sequence
  Description of Artificial Sequence: Synthetic oligonucleotide
atgcaagctctacaaactccgatcacc

SEQ ID NO: 8732 - protein, 9 aa, Artificial Sequence
  Description of Artificial Sequence: Synthetic peptide
MQALQTPIT

SEQ ID NO: 8733 - DNA, 27 bp, Artificial Sequence
  Description of Artificial Sequence: Synthetic oligonucleotide
cagcaatattatagtactccgctcact

SEQ ID NO: 8734 - protein, 9 aa, Artificial Sequence
  Description of Artificial Sequence: Synthetic peptide
QQYYSTPLT

SEQ ID NO: 8735 - DNA, 27 bp, Artificial Sequence
  Description of Artificial Sequence: Synthetic oligonucleotide
caacagagttacagtaccccattcact

SEQ ID NO: 8736 - protein, 9 aa, Artificial Sequence
  Description of Artificial Sequence: Synthetic peptide
QQSYSTPFT

SEQ ID NO: 8737 - DNA, 27 bp, Artificial Sequence
  Description of Artificial Sequence: Synthetic oligonucleotide
caacagagttacagtacccctccgacg

SEQ ID NO: 8738 - protein, 9 aa, Artificial Sequence
  Description of Artificial Sequence: Synthetic peptide
QQSYSTPPT

SEQ ID NO: 8739 - DNA, 30 bp, Artificial Sequence
  Description of Artificial Sequence: Synthetic oligonucleotide
agctcatatgcaggcagcaacaatgtggta

SEQ ID NO: 8740 - protein, 10 aa, Artificial Sequence
  Description of Artificial Sequence: Synthetic peptide
SSYAGSNNVV

SEQ ID NO: 8741 - DNA, 27 bp, Artificial Sequence
  Description of Artificial Sequence: Synthetic oligonucleotide
cagcagtatggaagctcaccgctcact

SEQ ID NO: 8742 - protein, 9 aa, Artificial Sequence
  Description of Artificial Sequence: Synthetic peptide
QQYGSSPLT

SEQ ID NO: 8743 - DNA, 27 bp, Artificial Sequence
  Description of Artificial Sequence: Synthetic oligonucleotide
cagcaatattatagtactccgtggacg

SEQ ID NO: 8744 - protein, 9 aa, Artificial Sequence
  Description of Artificial Sequence: Synthetic peptide
QQYYSTPWT

SEQ ID NO: 8745 - DNA, 27 bp, Artificial Sequence
  Description of Artificial Sequence: Synthetic oligonucleotide
cagcagtatggtacctcaccgctcact

SEQ ID NO: 8746 - protein, 9 aa, Artificial Sequence
  Description of Artificial Sequence: Synthetic peptide
QQYGTSPLT

SEQ ID NO: 8747 - DNA, 27 bp, Artificial Sequence
  Description of Artificial Sequence: Synthetic oligonucleotide
atgcaagttctacaaacccctccgacg

SEQ ID NO: 8748 - protein, 9 aa, Artificial Sequence
  Description of Artificial Sequence: Synthetic peptide
MQVLQTPPT

SEQ ID NO: 8749 - DNA, 27 bp, Artificial Sequence
  Description of Artificial Sequence: Synthetic oligonucleotide
cagcaatattatagtactccgctcact

SEQ ID NO: 8750 - protein, 9 aa, Artificial Sequence
  Description of Artificial Sequence: Synthetic peptide
QQYYSTPLT

SEQ ID NO: 8751 - DNA, 27 bp, Artificial Sequence
  Description of Artificial Sequence: Synthetic oligonucleotide
caacagagttacagtaccccgctcact

SEQ ID NO: 8752 - protein, 9 aa, Artificial Sequence
  Description of Artificial Sequence: Synthetic peptide
QQSYSTPLT

SEQ ID NO: 8753 - DNA, 27 bp, Artificial Sequence
  Description of Artificial Sequence: Synthetic oligonucleotide
caacagagttacagtatcccattcact

SEQ ID NO: 8754 - protein, 9 aa, Artificial Sequence
  Description of Artificial Sequence: Synthetic peptide
QQSYSIPFT

SEQ ID NO: 8755 - DNA, 27 bp, Artificial Sequence
  Description of Artificial Sequence: Synthetic oligonucleotide
caacagagttacagtaccccgctcact

SEQ ID NO: 8756 - protein, 9 aa, Artificial Sequence
  Description of Artificial Sequence: Synthetic peptide
QQSYSTPLT

SEQ ID NO: 8757 - DNA, 27 bp, Artificial Sequence
  Description of Artificial Sequence: Synthetic oligonucleotide
caaaagtattacagtgccccattcact

SEQ ID NO: 8758 - protein, 9 aa, Artificial Sequence
  Description of Artificial Sequence: Synthetic peptide
QKYYSAPFT

SEQ ID NO: 8759 - DNA, 27 bp, Artificial Sequence
  Description of Artificial Sequence: Synthetic oligonucleotide
caacagagttacagtaccccattcact

SEQ ID NO: 8760 - protein, 9 aa, Artificial Sequence
  Description of Artificial Sequence: Synthetic peptide
QQSYSTPFT

SEQ ID NO: 8761 - DNA, 33 bp, Artificial Sequence
  Description of Artificial Sequence: Synthetic oligonucleotide
tcagcatgggacagcagcctcagtgctgtggta

SEQ ID NO: 8762 - protein, 11 aa, Artificial Sequence
  Description of Artificial Sequence: Synthetic peptide
SAWDSSLSAVV

SEQ ID NO: 8763 - DNA, 27 bp, Artificial Sequence
  Description of Artificial Sequence: Synthetic oligonucleotide
caacagagttacagtacccctccgacg

SEQ ID NO: 8764 - protein, 9 aa, Artificial Sequence
  Description of Artificial Sequence: Synthetic peptide
QQSYSTPPT

SEQ ID NO: 8765 - DNA, 27 bp, Artificial Sequence
  Description of Artificial Sequence: Synthetic oligonucleotide
cagcagagttacagtgtccctccgacg

SEQ ID NO: 8766 - protein, 9 aa, Artificial Sequence
  Description of Artificial Sequence: Synthetic peptide
QQSYSVPPT

SEQ ID NO: 8767 - DNA, 27 bp, Artificial Sequence
  Description of Artificial Sequence: Synthetic oligonucleotide
atgcaagctctacaaactccattcact

SEQ ID NO: 8768 - protein, 9 aa, Artificial Sequence
  Description of Artificial Sequence: Synthetic peptide
MQALQTPFT

SEQ ID NO: 8769 - DNA, 27 bp, Artificial Sequence
  Description of Artificial Sequence: Synthetic oligonucleotide
atgcaagctctacaaactccattcact

SEQ ID NO: 8770 - protein, 9 aa, Artificial Sequence
  Description of Artificial Sequence: Synthetic peptide
MQALQTPFT

SEQ ID NO: 8771 - DNA, 27 bp, Artificial Sequence
  Description of Artificial Sequence: Synthetic oligonucleotide
atgcaagctctacaaactccgctcact

SEQ ID NO: 8772 - protein, 9 aa, Artificial Sequence
  Description of Artificial Sequence: Synthetic peptide
MQALQTPLT

SEQ ID NO: 8773 - DNA, 27 bp, Artificial Sequence
  Description of Artificial Sequence: Synthetic oligonucleotide
atgcaagctctacaaactcctcggacg

SEQ ID NO: 8774 - protein, 9 aa, Artificial Sequence
  Description of Artificial Sequence: Synthetic peptide
MQALQTPRT

SEQ ID NO: 8775 - DNA, 27 bp, Artificial Sequence
  Description of Artificial Sequence: Synthetic oligonucleotide
caacagacttacagtatgccattcact

SEQ ID NO: 8776 - protein, 9 aa, Artificial Sequence
  Description of Artificial Sequence: Synthetic peptide
QQTYSMPFT

SEQ ID NO: 8777 - DNA, 27 bp, Artificial Sequence
  Description of Artificial Sequence: Synthetic oligonucleotide
caacagagttacagtaccccattcact

SEQ ID NO: 8778 - protein, 9 aa, Artificial Sequence
  Description of Artificial Sequence: Synthetic peptide
QQSYSTPFT

SEQ ID NO: 8779 - DNA, 27 bp, Artificial Sequence
  Description of Artificial Sequence: Synthetic oligonucleotide
atgcaagctctacaaactcctcggacg

SEQ ID NO: 8780 - protein, 9 aa, Artificial Sequence
  Description of Artificial Sequence: Synthetic peptide
MQALQTPRT

SEQ ID NO: 8781 - DNA, 27 bp, Artificial Sequence
  Description of Artificial Sequence: Synthetic oligonucleotide
atgcaagctctacaaactcctcggacg

SEQ ID NO: 8782 - protein, 9 aa, Artificial Sequence
  Description of Artificial Sequence: Synthetic peptide
MQALQTPRT

SEQ ID NO: 8783 - DNA, 24 bp, Artificial Sequence
  Description of Artificial Sequence: Synthetic oligonucleotide
atgcaagctctacaaactcccagt

SEQ ID NO: 8784 - protein, 8 aa, Artificial Sequence
  Description of Artificial Sequence: Synthetic peptide
MQALQTPS

SEQ ID NO: 8785 - DNA, 27 bp, Artificial Sequence
  Description of Artificial Sequence: Synthetic oligonucleotide
atgcaagctctacaaactccattcact

SEQ ID NO: 8786 - protein, 9 aa, Artificial Sequence
  Description of Artificial Sequence: Synthetic peptide
MQALQTPFT

SEQ ID NO: 8787 - DNA, 27 bp, Artificial Sequence
  Description of Artificial Sequence: Synthetic oligonucleotide
caacagacttacagtatgccattcact

SEQ ID NO: 8788 - protein, 9 aa, Artificial Sequence
  Description of Artificial Sequence: Synthetic peptide
QQTYSMPFT

SEQ ID NO: 8789 - DNA, 27 bp, Artificial Sequence
  Description of Artificial Sequence: Synthetic oligonucleotide
caacagagttacagtaccccattcact

SEQ ID NO: 8790 - protein, 9 aa, Artificial Sequence
  Description of Artificial Sequence: Synthetic peptide
QQSYSTPFT

SEQ ID NO: 8791 - DNA, 27 bp, Artificial Sequence
  Description of Artificial Sequence: Synthetic oligonucleotide
caacagacttacagtatgccattcact

SEQ ID NO: 8792 - protein, 9 aa, Artificial Sequence
  Description of Artificial Sequence: Synthetic peptide
QQTYSMPFT

SEQ ID NO: 8793 - DNA, 24 bp, Artificial Sequence
  Description of Artificial Sequence: Synthetic oligonucleotide
atgcaagctctacaaactcccagt

SEQ ID NO: 8794 - protein, 8 aa, Artificial Sequence
  Description of Artificial Sequence: Synthetic peptide
MQALQTPS

SEQ ID NO: 8795 - DNA, 27 bp, Artificial Sequence
  Description of Artificial Sequence: Synthetic oligonucleotide
atgcaagctctccaaactccattcact

SEQ ID NO: 8796 - protein, 9 aa, Artificial Sequence
  Description of Artificial Sequence: Synthetic peptide
MQALQTPFT

SEQ ID NO: 8797 - DNA, 27 bp, Artificial Sequence
  Description of Artificial Sequence: Synthetic oligonucleotide
atgcaagctctacaaactcctcggacg

SEQ ID NO: 8798 - protein, 9 aa, Artificial Sequence
  Description of Artificial Sequence: Synthetic peptide
MQALQTPRT

SEQ ID NO: 8799 - DNA, 27 bp, Artificial Sequence
  Description of Artificial Sequence: Synthetic oligonucleotide
atgcaagctctacaaactcctcggacg

SEQ ID NO: 8800 - protein, 9 aa, Artificial Sequence
  Description of Artificial Sequence: Synthetic peptide
MQALQTPRT

SEQ ID NO: 8801 - DNA, 27 bp, Artificial Sequence
  Description of Artificial Sequence: Synthetic oligonucleotide
atgcaagctctacaaactcctcggacg

SEQ ID NO: 8802 - protein, 9 aa, Artificial Sequence
  Description of Artificial Sequence: Synthetic peptide
MQALQTPRT

SEQ ID NO: 8803 - DNA, 24 bp, Artificial Sequence
  Description of Artificial Sequence: Synthetic oligonucleotide
atgcaagctctacaaactcccagt

SEQ ID NO: 8804 - protein, 8 aa, Artificial Sequence
  Description of Artificial Sequence: Synthetic peptide
MQALQTPS

SEQ ID NO: 8805 - DNA, 27 bp, Artificial Sequence
  Description of Artificial Sequence: Synthetic oligonucleotide
atgcaaagtctacatcttcctcccact

SEQ ID NO: 8806 - protein, 9 aa, Artificial Sequence
  Description of Artificial Sequence: Synthetic peptide
MQSLHLPPT

SEQ ID NO: 8807 - DNA, 27 bp, Artificial Sequence
  Description of Artificial Sequence: Synthetic oligonucleotide
atgcaagctctacaaactccattcact

SEQ ID NO: 8808 - protein, 9 aa, Artificial Sequence
  Description of Artificial Sequence: Synthetic peptide
MQALQTPFT

SEQ ID NO: 8809 - DNA, 27 bp, Artificial Sequence
  Description of Artificial Sequence: Synthetic oligonucleotide
atgcaagctctccaaactccattcact

SEQ ID NO: 8810 - protein, 9 aa, Artificial Sequence
  Description of Artificial Sequence: Synthetic peptide
MQALQTPFT

SEQ ID NO: 8811 - DNA, 27 bp, Artificial Sequence
  Description of Artificial Sequence: Synthetic oligonucleotide
atgcaaggtctacaaactcctcggacg

SEQ ID NO: 8812 - protein, 9 aa, Artificial Sequence
  Description of Artificial Sequence: Synthetic peptide
MQGLQTPRT

SEQ ID NO: 8813 - DNA, 27 bp, Artificial Sequence
  Description of Artificial Sequence: Synthetic oligonucleotide
caacagacttacagtatgccattcact

SEQ ID NO: 8814 - protein, 9 aa, Artificial Sequence
  Description of Artificial Sequence: Synthetic peptide
QQTYSMPFT

SEQ ID NO: 8815 - DNA, 27 bp, Artificial Sequence
  Description of Artificial Sequence: Synthetic oligonucleotide
atgcaagctctacaaactcctcggacg

SEQ ID NO: 8816 - protein, 9 aa, Artificial Sequence
  Description of Artificial Sequence: Synthetic peptide
MQALQTPRT

SEQ ID NO: 8817 - DNA, 33 bp, Artificial Sequence
  Description of Artificial Sequence: Synthetic oligonucleotide
caggtgtgggatagcagtagtgatcatgtggta

SEQ ID NO: 8818 - protein, 11 aa, Artificial Sequence
  Description of Artificial Sequence: Synthetic peptide
QVWDSSSDHVV

SEQ ID NO: 8819 - DNA, 33 bp, Artificial Sequence
  Description of Artificial Sequence: Synthetic oligonucleotide
caggtgtgggatagtagtagtgatcatgtggta

SEQ ID NO: 8820 - protein, 11 aa, Artificial Sequence
  Description of Artificial Sequence: Synthetic peptide
QVWDSSSDHVV

SEQ ID NO: 8821 - DNA, 33 bp, Artificial Sequence; identical to SEQ ID NO: 8819
  Description of Artificial Sequence: Synthetic oligonucleotide

SEQ ID NO: 8822 - protein, 11 aa, Artificial Sequence
  Description of Artificial Sequence: Synthetic peptide
QVWDSSSDHVV

SEQ ID NO: 8823 - DNA, 33 bp, Artificial Sequence; identical to SEQ ID NO: 8819
  Description of Artificial Sequence: Synthetic oligonucleotide

SEQ ID NO: 8824 - protein, 11 aa, Artificial Sequence
  Description of Artificial Sequence: Synthetic peptide
QVWDSSSDHVV

SEQ ID NO: 8825 - DNA, 33 bp, Artificial Sequence; identical to SEQ ID NO: 8819
  Description of Artificial Sequence: Synthetic oligonucleotide

SEQ ID NO: 8826 - protein, 11 aa, Artificial Sequence
  Description of Artificial Sequence: Synthetic peptide
QVWDSSSDHVV

SEQ ID NO: 8827 - DNA, 33 bp, Artificial Sequence; identical to SEQ ID NO: 8819
  Description of Artificial Sequence: Synthetic oligonucleotide

SEQ ID NO: 8828 - protein, 11 aa, Artificial Sequence
  Description of Artificial Sequence: Synthetic peptide
QVWDSSSDHVV

SEQ ID NO: 8829 - DNA, 33 bp, Artificial Sequence; identical to SEQ ID NO: 8817
  Description of Artificial Sequence: Synthetic oligonucleotide

SEQ ID NO: 8830 - protein, 11 aa, Artificial Sequence
  Description of Artificial Sequence: Synthetic peptide
QVWDSSSDHVV

SEQ ID NO: 8831 - DNA, 33 bp, Artificial Sequence; identical to SEQ ID NO: 8819
  Description of Artificial Sequence: Synthetic oligonucleotide

SEQ ID NO: 8832 - protein, 11 aa, Artificial Sequence
  Description of Artificial Sequence: Synthetic peptide
QVWDSSSDHVV

SEQ ID NO: 8833 - DNA, 33 bp, Artificial Sequence; identical to SEQ ID NO: 8819
  Description of Artificial Sequence: Synthetic oligonucleotide

SEQ ID NO: 8834 - protein, 11 aa, Artificial Sequence
  Description of Artificial Sequence: Synthetic peptide
QVWDSSSDHVV

SEQ ID NO: 8835 - DNA, 33 bp, Artificial Sequence; identical to SEQ ID NO: 8819
  Description of Artificial Sequence: Synthetic oligonucleotide

SEQ ID NO: 8836 - protein, 11 aa, Artificial Sequence
  Description of Artificial Sequence: Synthetic peptide
QVWDSSSDHVV

SEQ ID NO: 8837 - DNA, 33 bp, Artificial Sequence; identical to SEQ ID NO: 8817
  Description of Artificial Sequence: Synthetic oligonucleotide

SEQ ID NO: 8838 - protein, 11 aa, Artificial Sequence
  Description of Artificial Sequence: Synthetic peptide
QVWDSSSDHVV

SEQ ID NO: 8839 - DNA, 33 bp, Artificial Sequence; identical to SEQ ID NO: 8819
  Description of Artificial Sequence: Synthetic oligonucleotide

SEQ ID NO: 8840 - protein, 11 aa, Artificial Sequence
  Description of Artificial Sequence: Synthetic peptide
QVWDSSSDHVV

SEQ ID NO: 8841 - DNA, 33 bp, Artificial Sequence
  Description of Artificial Sequence: Synthetic oligonucleotide
caggtgtgggatagcagtagtgatcatgcggta

SEQ ID NO: 8842 - protein, 11 aa, Artificial Sequence
  Description of Artificial Sequence: Synthetic peptide
QVWDSSSDHAV

SEQ ID NO: 8843 - DNA, 33 bp, Artificial Sequence; identical to SEQ ID NO: 8819
  Description of Artificial Sequence: Synthetic oligonucleotide

SEQ ID NO: 8844 - protein, 11 aa, Artificial Sequence
  Description of Artificial Sequence: Synthetic peptide
QVWDSSSDHVV

SEQ ID NO: 8845 - DNA, 33 bp, Artificial Sequence; identical to SEQ ID NO: 8819
  Description of Artificial Sequence: Synthetic oligonucleotide

SEQ ID NO: 8846 - protein, 11 aa, Artificial Sequence
  Description of Artificial Sequence: Synthetic peptide
QVWDSSSDHVV

SEQ ID NO: 8847 - DNA, 33 bp, Artificial Sequence; identical to SEQ ID NO: 8817
  Description of Artificial Sequence: Synthetic oligonucleotide

SEQ ID NO: 8848 - protein, 11 aa, Artificial Sequence
  Description of Artificial Sequence: Synthetic peptide
QVWDSSSDHVV

SEQ ID NO: 8849 - DNA, 33 bp, Artificial Sequence; identical to SEQ ID NO: 8819
  Description of Artificial Sequence: Synthetic oligonucleotide

SEQ ID NO: 8850 - protein, 11 aa, Artificial Sequence
  Description of Artificial Sequence: Synthetic peptide
QVWDSSSDHVV

SEQ ID NO: 8851 - DNA, 33 bp, Artificial Sequence; identical to SEQ ID NO: 8817
  Description of Artificial Sequence: Synthetic oligonucleotide

SEQ ID NO: 8852 - protein, 11 aa, Artificial Sequence
  Description of Artificial Sequence: Synthetic peptide
QVWDSSSDHVV

SEQ ID NO: 8853 - DNA, 33 bp, Artificial Sequence
  Description of Artificial Sequence: Synthetic oligonucleotide
caggtgtgggatagtagtagtgatcatgtgata

SEQ ID NO: 8854 - protein, 11 aa, Artificial Sequence
  Description of Artificial Sequence: Synthetic peptide
QVWDSSSDHVI

SEQ ID NO: 8855 - DNA, 33 bp, Artificial Sequence
  Description of Artificial Sequence: Synthetic oligonucleotide
caggtgtgggatagtaatagtgatcatgtggta

SEQ ID NO: 8856 - protein, 11 aa, Artificial Sequence
  Description of Artificial Sequence: Synthetic peptide
QVWDSNSDHVV

SEQ ID NO: 8857 - DNA, 33 bp, Artificial Sequence; identical to SEQ ID NO: 8853
  Description of Artificial Sequence: Synthetic oligonucleotide

SEQ ID NO: 8858 - protein, 11 aa, Artificial Sequence
  Description of Artificial Sequence: Synthetic peptide
QVWDSSSDHVI

SEQ ID NO: 8859 - DNA, 33 bp, Artificial Sequence; identical to SEQ ID NO: 8819
  Description of Artificial Sequence: Synthetic oligonucleotide

SEQ ID NO: 8860 - protein, 11 aa, Artificial Sequence
  Description of Artificial Sequence: Synthetic peptide
QVWDSSSDHVV

SEQ ID NO: 8861 - DNA, 33 bp, Artificial Sequence; identical to SEQ ID NO: 8819
  Description of Artificial Sequence: Synthetic oligonucleotide

SEQ ID NO: 8862 - protein, 11 aa, Artificial Sequence
  Description of Artificial Sequence: Synthetic peptide
QVWDSSSDHVV

SEQ ID NO: 8863 - DNA, 33 bp, Artificial Sequence; identical to SEQ ID NO: 8817
  Description of Artificial Sequence: Synthetic oligonucleotide

SEQ ID NO: 8864 - protein, 11 aa, Artificial Sequence
  Description of Artificial Sequence: Synthetic peptide
QVWDSSSDHVV

SEQ ID NO: 8865 - DNA, 33 bp, Artificial Sequence; identical to SEQ ID NO: 8819
  Description of Artificial Sequence: Synthetic oligonucleotide

SEQ ID NO: 8866 - protein, 11 aa, Artificial Sequence
  Description of Artificial Sequence: Synthetic peptide
QVWDSSSDHVV

SEQ ID NO: 8867 - DNA, 33 bp, Artificial Sequence; identical to SEQ ID NO: 8817
  Description of Artificial Sequence: Synthetic oligonucleotide

SEQ ID NO: 8868 - protein, 11 aa, Artificial Sequence
  Description of Artificial Sequence: Synthetic peptide
QVWDSSSDHVV

SEQ ID NO: 8869 - DNA, 33 bp, Artificial Sequence
  Description of Artificial Sequence: Synthetic oligonucleotide
caggtgtgggatagtagtagtgatcatgtgatg

SEQ ID NO: 8870 - protein, 11 aa, Artificial Sequence
  Description of Artificial Sequence: Synthetic peptide
QVWDSSSDHVM

SEQ ID NO: 8871 - DNA, 33 bp, Artificial Sequence; identical to SEQ ID NO: 8819
  Description of Artificial Sequence: Synthetic oligonucleotide

SEQ ID NO: 8872 - protein, 11 aa, Artificial Sequence
  Description of Artificial Sequence: Synthetic peptide
QVWDSSSDHVV

SEQ ID NO: 8873 - DNA, 33 bp, Artificial Sequence; identical to SEQ ID NO: 8817
  Description of Artificial Sequence: Synthetic oligonucleotide

SEQ ID NO: 8874 - protein, 11 aa, Artificial Sequence
  Description of Artificial Sequence: Synthetic peptide
QVWDSSSDHVV

SEQ ID NO: 8875 - DNA, 33 bp, Artificial Sequence; identical to SEQ ID NO: 8817
  Description of Artificial Sequence: Synthetic oligonucleotide

SEQ ID NO: 8876 - protein, 11 aa, Artificial Sequence
  Description of Artificial Sequence: Synthetic peptide
QVWDSSSDHVV

SEQ ID NO: 8877 - DNA, 33 bp, Artificial Sequence; identical to SEQ ID NO: 8817
  Description of Artificial Sequence: Synthetic oligonucleotide

SEQ ID NO: 8878 - protein, 11 aa, Artificial Sequence
  Description of Artificial Sequence: Synthetic peptide
QVWDSSSDHVV

SEQ ID NO: 8879 - DNA, 33 bp, Artificial Sequence; identical to SEQ ID NO: 8817
  Description of Artificial Sequence: Synthetic oligonucleotide

SEQ ID NO: 8880 - protein, 11 aa, Artificial Sequence
  Description of Artificial Sequence: Synthetic peptide
QVWDSSSDHVV

SEQ ID NO: 8881 - DNA, 33 bp, Artificial Sequence; identical to SEQ ID NO: 8817
  Description of Artificial Sequence: Synthetic oligonucleotide

SEQ ID NO: 8882 - protein, 11 aa, Artificial Sequence
  Description of Artificial Sequence: Synthetic peptide
QVWDSSSDHVV

SEQ ID NO: 8883 - DNA, 33 bp, Artificial Sequence; identical to SEQ ID NO: 8819
  Description of Artificial Sequence: Synthetic oligonucleotide

SEQ ID NO: 8884 - protein, 11 aa, Artificial Sequence
  Description of Artificial Sequence: Synthetic peptide
QVWDSSSDHVV

SEQ ID NO: 8885 - DNA, 27 bp, Artificial Sequence
  Description of Artificial Sequence: Synthetic oligonucleotide
caaaagtataacagtgccccattcact

SEQ ID NO: 8886 - protein, 9 aa, Artificial Sequence
  Description of Artificial Sequence: Synthetic peptide
QKYNSAPFT

SEQ ID NO: 8887 - DNA, 27 bp, Artificial Sequence
  Description of Artificial Sequence: Synthetic oligonucleotide
caaaagtataacagtgccccattcact

SEQ ID NO: 8888 - protein, 9 aa, Artificial Sequence
  Description of Artificial Sequence: Synthetic peptide
QKYNSAPFT

SEQ ID NO: 8889 - DNA, 27 bp, Artificial Sequence
  Description of Artificial Sequence: Synthetic oligonucleotide
caaaagtataacagtgccccattcact

SEQ ID NO: 8890 - protein, 9 aa, Artificial Sequence
  Description of Artificial Sequence: Synthetic peptide
QKYNSAPFT

SEQ ID NO: 8891 - DNA, 36 bp, Artificial Sequence
  Description of Artificial Sequence: Synthetic oligonucleotide
caggtgtgggatagtagtagtgatcatcatgtggta

SEQ ID NO: 8892 - protein, 12 aa, Artificial Sequence
  Description of Artificial Sequence: Synthetic peptide
QVWDSSSDHHVV

SEQ ID NO: 8893 - DNA, 33 bp, Artificial Sequence; identical to SEQ ID NO: 8819
  Description of Artificial Sequence: Synthetic oligonucleotide

SEQ ID NO: 8894 - protein, 11 aa, Artificial Sequence
  Description of Artificial Sequence: Synthetic peptide
QVWDSSSDHVV

SEQ ID NO: 8895 - DNA, 33 bp, Artificial Sequence; identical to SEQ ID NO: 8819
  Description of Artificial Sequence: Synthetic oligonucleotide

SEQ ID NO: 8896 - protein, 11 aa, Artificial Sequence
  Description of Artificial Sequence: Synthetic peptide
QVWDSSSDHVV

SEQ ID NO: 8897 - DNA, 33 bp, Artificial Sequence; identical to SEQ ID NO: 8817
  Description of Artificial Sequence: Synthetic oligonucleotide

SEQ ID NO: 8898 - protein, 11 aa, Artificial Sequence
  Description of Artificial Sequence: Synthetic peptide
QVWDSSSDHVV

SEQ ID NO: 8899 - DNA, 33 bp, Artificial Sequence; identical to SEQ ID NO: 8819
  Description of Artificial Sequence: Synthetic oligonucleotide

SEQ ID NO: 8900 - protein, 11 aa, Artificial Sequence
  Description of Artificial Sequence: Synthetic peptide
QVWDSSSDHVV

SEQ ID NO: 8901 - DNA, 33 bp, Artificial Sequence; identical to SEQ ID NO: 8853
  Description of Artificial Sequence: Synthetic oligonucleotide

SEQ ID NO: 8902 - protein, 11 aa, Artificial Sequence
  Description of Artificial Sequence: Synthetic peptide
QVWDSSSDHVI

SEQ ID NO: 8903 - DNA, 33 bp, Artificial Sequence; identical to SEQ ID NO: 8817
  Description of Artificial Sequence: Synthetic oligonucleotide

SEQ ID NO: 8904 - protein, 11 aa, Artificial Sequence
  Description of Artificial Sequence: Synthetic peptide
QVWDSSSDHVV

SEQ ID NO: 8905 - DNA, 33 bp, Artificial Sequence; identical to SEQ ID NO: 8819
  Description of Artificial Sequence: Synthetic oligonucleotide

SEQ ID NO: 8906 - protein, 11 aa, Artificial Sequence
  Description of Artificial Sequence: Synthetic peptide
QVWDSSSDHVV

SEQ ID NO: 8907 - DNA, 33 bp, Artificial Sequence; identical to SEQ ID NO: 8819
  Description of Artificial Sequence: Synthetic oligonucleotide

SEQ ID NO: 8908 - protein, 11 aa, Artificial Sequence
  Description of Artificial Sequence: Synthetic peptide
QVWDSSSDHVV

SEQ ID NO: 8909 - DNA, 33 bp, Artificial Sequence
  Description of Artificial Sequence: Synthetic oligonucleotide
caggtgtgggattatagtagtgatcatgtggtg

SEQ ID NO: 8910 - protein, 11 aa, Artificial Sequence
  Description of Artificial Sequence: Synthetic peptide
QVWDYSSDHVV

SEQ ID NO: 8911 - DNA, 33 bp, Artificial Sequence; identical to SEQ ID NO: 8909
  Description of Artificial Sequence: Synthetic oligonucleotide

SEQ ID NO: 8912 - protein, 11 aa, Artificial Sequence
  Description of Artificial Sequence: Synthetic peptide
QVWDYSSDHVV

SEQ ID NO: 8913 - DNA, 33 bp, Artificial Sequence; identical to SEQ ID NO: 8817
  Description of Artificial Sequence: Synthetic oligonucleotide

SEQ ID NO: 8914 - protein, 11 aa, Artificial Sequence
  Description of Artificial Sequence: Synthetic peptide
QVWDSSSDHVV

SEQ ID NO: 8915 - DNA, 33 bp, Artificial Sequence; identical to SEQ ID NO: 8819
  Description of Artificial Sequence: Synthetic oligonucleotide

SEQ ID NO: 8916 - protein, 11 aa, Artificial Sequence
  Description of Artificial Sequence: Synthetic peptide
QVWDSSSDHVV

SEQ ID NO: 8917 - DNA, 27 bp, Artificial Sequence
  Description of Artificial Sequence: Synthetic oligonucleotide
cagcagttttatagtactccgatcacc

SEQ ID NO: 8918 - protein, 9 aa, Artificial Sequence
  Description of Artificial Sequence: Synthetic peptide
QQFYSTPIT

SEQ ID NO: 8919 - DNA, 27 bp, Artificial Sequence
  Description of Artificial Sequence: Synthetic oligonucleotide
cagcaatattatagtactccgctcact

SEQ ID NO: 8920 - protein, 9 aa, Artificial Sequence
  Description of Artificial Sequence: Synthetic peptide
QQYYSTPLT

SEQ ID NO: 8921 - DNA, 27 bp, Artificial Sequence
  Description of Artificial Sequence: Synthetic oligonucleotide
caacagagttacattaccccgttcact

SEQ ID NO: 8922 - protein, 9 aa, Artificial Sequence
  Description of Artificial Sequence: Synthetic peptide
QQSYITPFT

SEQ ID NO: 8923 - DNA, 27 bp, Artificial Sequence
  Description of Artificial Sequence: Synthetic oligonucleotide
caacagagttacagtacccctttcact

SEQ ID NO: 8924 - protein, 9 aa, Artificial Sequence
  Description of Artificial Sequence: Synthetic peptide
QQSYSTPFT

SEQ ID NO: 8925 - DNA, 27 bp, Artificial Sequence
  Description of Artificial Sequence: Synthetic oligonucleotide
caacagagttacagtaccccgatcacc

SEQ ID NO: 8926 - protein, 9 aa, Artificial Sequence
  Description of Artificial Sequence: Synthetic peptide
QQSYSTPIT

SEQ ID NO: 8927 - DNA, 27 bp, Artificial Sequence
  Description of Artificial Sequence: Synthetic oligonucleotide
caacagagttacagtaccccattcact

SEQ ID NO: 8928 - protein, 9 aa, Artificial Sequence
  Description of Artificial Sequence: Synthetic peptide
QQSYSTPFT

SEQ ID NO: 8929 - DNA, 27 bp, Artificial Sequence
  Description of Artificial Sequence: Synthetic oligonucleotide
caacagagttacactaccccattcact

SEQ ID NO: 8930 - protein, 9 aa, Artificial Sequence
  Description of Artificial Sequence: Synthetic peptide
QQSYTTPFT

SEQ ID NO: 8931 - DNA, 27 bp, Artificial Sequence
  Description of Artificial Sequence: Synthetic oligonucleotide
caacagagttacagtaccccattcact

SEQ ID NO: 8932 - protein, 9 aa, Artificial Sequence
  Description of Artificial Sequence: Synthetic peptide
QQSYSTPFT

SEQ ID NO: 8933 - DNA, 27 bp, Artificial Sequence
  Description of Artificial Sequence: Synthetic oligonucleotide
caacagagttacagtattccgctcact

SEQ ID NO: 8934 - protein, 9 aa, Artificial Sequence
  Description of Artificial Sequence: Synthetic peptide
QQSYSIPLT

SEQ ID NO: 8935 - DNA, 27 bp, Artificial Sequence
  Description of Artificial Sequence: Synthetic oligonucleotide
caacagacttacagtatgccattcact

SEQ ID NO: 8936 - protein, 9 aa, Artificial Sequence
  Description of Artificial Sequence: Synthetic peptide
QQTYSMPFT

SEQ ID NO: 8937 - DNA, 27 bp, Artificial Sequence
  Description of Artificial Sequence: Synthetic oligonucleotide
caacagagttacagtagtccattcact

SEQ ID NO: 8938 - protein, 9 aa, Artificial Sequence
  Description of Artificial Sequence: Synthetic peptide
QQSYSSPFT

SEQ ID NO: 8939 - DNA, 27 bp, Artificial Sequence
  Description of Artificial Sequence: Synthetic oligonucleotide
caacagacttacagtatgccattcact

SEQ ID NO: 8940 - protein, 9 aa, Artificial Sequence
  Description of Artificial Sequence: Synthetic peptide
QQTYSMPFT

SEQ ID NO: 8941 - DNA, 27 bp, Artificial Sequence
  Description of Artificial Sequence: Synthetic oligonucleotide
caacagacttacagtatgccattcact

SEQ ID NO: 8942 - protein, 9 aa, Artificial Sequence
  Description of Artificial Sequence: Synthetic peptide
QQTYSMPFT

SEQ ID NO: 8943 - DNA, 27 bp, Artificial Sequence
  Description of Artificial Sequence: Synthetic oligonucleotide
caacagacttacagtatgccattcact

SEQ ID NO: 8944 - protein, 9 aa, Artificial Sequence
  Description of Artificial Sequence: Synthetic peptide
QQTYSMPFT

SEQ ID NO: 8945 - DNA, 27 bp, Artificial Sequence
  Description of Artificial Sequence: Synthetic oligonucleotide
caacagacttacagtatgccattcact

SEQ ID NO: 8946 - protein, 9 aa, Artificial Sequence
  Description of Artificial Sequence: Synthetic peptide
QQTYSMPFT

SEQ ID NO: 8947 - DNA, 27 bp, Artificial Sequence
  Description of Artificial Sequence: Synthetic oligonucleotide
atgcaagctctacaaactccgtggacg

SEQ ID NO: 8948 - protein, 9 aa, Artificial Sequence
  Description of Artificial Sequence: Synthetic peptide
MQALQTPWT

SEQ ID NO: 8949 - DNA, 27 bp, Artificial Sequence
  Description of Artificial Sequence: Synthetic oligonucleotide
atgcaagctctacaaactcctcggacg

SEQ ID NO: 8950 - protein, 9 aa, Artificial Sequence
  Description of Artificial Sequence: Synthetic peptide
MQALQTPRT

SEQ ID NO: 8951 - DNA, 27 bp, Artificial Sequence
  Description of Artificial Sequence: Synthetic oligonucleotide
caacagacttacagtatgccattcact

SEQ ID NO: 8952 - protein, 9 aa, Artificial Sequence
  Description of Artificial Sequence: Synthetic peptide
QQTYSMPFT

SEQ ID NO: 8953 - DNA, 27 bp, Artificial Sequence
  Description of Artificial Sequence: Synthetic oligonucleotide
caacagagttacagtagtccattcact

SEQ ID NO: 8954 - protein, 9 aa, Artificial Sequence
  Description of Artificial Sequence: Synthetic peptide
QQSYSSPFT

SEQ ID NO: 8955 - DNA, 27 bp, Artificial Sequence
  Description of Artificial Sequence: Synthetic oligonucleotide
caacagacttacagtagtccattcact

SEQ ID NO: 8956 - protein, 9 aa, Artificial Sequence
  Description of Artificial Sequence: Synthetic peptide
QQTYSSPFT

SEQ ID NO: 8957 - DNA, 27 bp, Artificial Sequence
  Description of Artificial Sequence: Synthetic oligonucleotide
atgcaggctctacaaactcctcggacg

SEQ ID NO: 8958 - protein, 9 aa, Artificial Sequence
  Description of Artificial Sequence: Synthetic peptide
MQALQTPRT

SEQ ID NO: 8959 - DNA, 27 bp, Artificial Sequence
  Description of Artificial Sequence: Synthetic oligonucleotide
atgcaaggtctacaaactccattcact

SEQ ID NO: 8960 - protein, 9 aa, Artificial Sequence
  Description of Artificial Sequence: Synthetic peptide
MQGLQTPFT

SEQ ID NO: 8961 - DNA, 24 bp, Artificial Sequence
  Description of Artificial Sequence: Synthetic oligonucleotide
atgcaagctctacaaactcccagt

SEQ ID NO: 8962 - protein, 8 aa, Artificial Sequence
  Description of Artificial Sequence: Synthetic peptide
MQALQTPS

SEQ ID NO: 8963 - DNA, 27 bp, Artificial Sequence
  Description of Artificial Sequence: Synthetic oligonucleotide
caacagacttacagtatgccattcact

SEQ ID NO: 8964 - protein, 9 aa, Artificial Sequence
  Description of Artificial Sequence: Synthetic peptide
QQTYSMPFT

SEQ ID NO: 8965 - protein, 11 aa, Artificial Sequence
  Description of Artificial Sequence: Synthetic peptide
QVWDYRYLSQV

SEQ ID NO: 8966 - protein, 11 aa, Artificial Sequence
  Description of Artificial Sequence: Synthetic peptide
QVWDYSGQRQV

SEQ ID NO: 8967 - protein, 9 aa, Artificial Sequence
  Description of Artificial Sequence: Synthetic peptide
QKYNSAPFT

SEQ ID NO: 8968 - protein, 12 aa, Artificial Sequence
  Description of Artificial Sequence: Synthetic peptide
QVWDASAGYGVV

SEQ ID NO: 8969 - protein, 9 aa, Artificial Sequence
  Description of Artificial Sequence: Synthetic peptide
MQALQTPWT

SEQ ID NO: 8970 - protein, 9 aa, Artificial Sequence
  Description of Artificial Sequence: Synthetic peptide
QQFYSTPIT

SEQ ID NO: 8971 - protein, 11 aa, Artificial Sequence
  Description of Artificial Sequence: Synthetic peptide
QVWDYSPLRHV

SEQ ID NO: 8972 - protein, 11 aa, Artificial Sequence
  Description of Artificial Sequence: Synthetic peptide
QVWDYRTLDWV

SEQ ID NO: 8973 - protein, 11 aa, Artificial Sequence
  Description of Artificial Sequence: Synthetic peptide
QVWDYRTLDWV

SEQ ID NO: 8974 - protein, 11 aa, Artificial Sequence
  Description of Artificial Sequence: Synthetic peptide
QVWDYYSNRAV

SEQ ID NO: 8975 - protein, 11 aa, Artificial Sequence
  Description of Artificial Sequence: Synthetic peptide
QVWDYRYLSQV

SEQ ID NO: 8976 - protein, 11 aa, Artificial Sequence
  Description of Artificial Sequence: Synthetic peptide
QVWDYRYLSQV

SEQ ID NO: 8977 - protein, 11 aa, Artificial Sequence
  Description of Artificial Sequence: Synthetic peptide
QVWDYSGQRQV

SEQ ID NO: 8978 - protein, 11 aa, Artificial Sequence
  Description of Artificial Sequence: Synthetic peptide
QVWDYSGQRQV

SEQ ID NO: 8979 - protein, 9 aa, Artificial Sequence
  Description of Artificial Sequence: Synthetic peptide
QQSYSSPFT

SEQ ID NO: 8980 - protein, 9 aa, Artificial Sequence
  Description of Artificial Sequence: Synthetic peptide
QQSYYYPTL

SEQ ID NO: 8981 - protein, 9 aa, Artificial Sequence
  Description of Artificial Sequence: Synthetic peptide
QQSYITPFT

SEQ ID NO: 8982 - protein, 9 aa, Artificial Sequence
  Description of Artificial Sequence: Synthetic peptide
QQSYFPVVE

SEQ ID NO: 8983 - protein, 9 aa, Artificial Sequence
  Description of Artificial Sequence: Synthetic peptide
QQSYTPPTT

SEQ ID NO: 8984 - protein, 9 aa, Artificial Sequence
  Description of Artificial Sequence: Synthetic peptide
QQTYSMPFT

SEQ ID NO: 8985 - protein, 9 aa, Artificial Sequence
  Description of Artificial Sequence: Synthetic peptide
IQAYTSPFT

SEQ ID NO: 8986 - protein, 9 aa, Artificial Sequence
  Description of Artificial Sequence: Synthetic peptide
QQTYSMPFT

SEQ ID NO: 8987 - protein, 9 aa, Artificial Sequence
  Description of Artificial Sequence: Synthetic peptide
QQTYSMPFT

SEQ ID NO: 8988 - protein, 11 aa, Artificial Sequence
  Description of Artificial Sequence: Synthetic peptide
QVWDYVAPRHV

SEQ ID NO: 8989 - protein, 11 aa, Artificial Sequence
  Description of Artificial Sequence: Synthetic peptide
QVWDYVAPRHV

SEQ ID NO: 8990 - protein, 9 aa, Artificial Sequence
  Description of Artificial Sequence: Synthetic peptide
QQTYSMPFT

SEQ ID NO: 8991 - protein, 9 aa, Artificial Sequence
  Description of Artificial Sequence: Synthetic peptide
QQTYSSPFT

SEQ ID NO: 8992 - protein, 9 aa, Artificial Sequence
  Description of Artificial Sequence: Synthetic peptide
QKYNSAPFT

SEQ ID NO: 8993 - DNA, 30 bp, Artificial Sequence
  Description of Artificial Sequence: Synthetic oligonucleotide
gatggagtcttctatgcccctcttgcttac

SEQ ID NO: 8994 - protein, 10 aa, Artificial Sequence
  Description of Artificial Sequence: Synthetic peptide
DGVFYAPLAY

SEQ ID NO: 8995 - DNA, 39 bp, Artificial Sequence
  Description of Artificial Sequence: Synthetic oligonucleotide
ggcaattacttcggtagtagcgaggcctactttgactac

SEQ ID NO: 8996 - protein, 13 aa, Artificial Sequence
  Description of Artificial Sequence: Synthetic peptide
GNYFGSSEAYFDY

SEQ ID NO: 8997 - DNA, 33 bp, Artificial Sequence
  Description of Artificial Sequence: Synthetic oligonucleotide
cgacaacttaaccacgtctttgctatggactac

SEQ ID NO: 8998 - protein, 11 aa, Artificial Sequence
  Description of Artificial Sequence: Synthetic peptide
RQLNHVFAMDY

SEQ ID NO: 8999 - DNA, 42 bp, Artificial Sequence
  Description of Artificial Sequence: Synthetic oligonucleotide
gggggtggatacagcaatggttacgactacggtatggacgtc

SEQ ID NO: 9000 - protein, 14 aa, Artificial Sequence
  Description of Artificial Sequence: Synthetic peptide
GGGYSNGYDYGMDV

SEQ ID NO: 9001 - DNA, 42 bp, Artificial Sequence
  Description of Artificial Sequence: Synthetic oligonucleotide
gggggtggatacagctatggttacgactacggtatggacgtc

SEQ ID NO: 9002 - protein, 14 aa, Artificial Sequence
  Description of Artificial Sequence: Synthetic peptide
GGGYSYGYDYGMDV

SEQ ID NO: 9003 - DNA, 42 bp, Artificial Sequence
  Description of Artificial Sequence: Synthetic oligonucleotide
ggcggtggatacagtcatggttatgactacggtatggacgtc

SEQ ID NO: 9004 - protein, 14 aa, Artificial Sequence
  Description of Artificial Sequence: Synthetic peptide
GGGYSHGYDYGMDV

SEQ ID NO: 9005 - DNA, 33 bp, Artificial Sequence
  Description of Artificial Sequence: Synthetic oligonucleotide
cacctacgatattttgactggccccttgactac

SEQ ID NO: 9006 - protein, 11 aa, Artificial Sequence
  Description of Artificial Sequence: Synthetic peptide
HLRYFDWPLDY

SEQ ID NO: 9007 - DNA, 36 bp, Artificial Sequence
  Description of Artificial Sequence: Synthetic oligonucleotide
gagcagtggcccaactactactacggtatggacgtc

SEQ ID NO: 9008 - protein, 12 aa, Artificial Sequence
  Description of Artificial Sequence: Synthetic peptide
EQWPNYYYGMDV

SEQ ID NO: 9009 - DNA, 42 bp, Artificial Sequence
  Description of Artificial Sequence: Synthetic oligonucleotide
ggcggtggatacagctatggttacgactacggtatggacgtc

SEQ ID NO: 9010 - protein, 14 aa, Artificial Sequence
  Description of Artificial Sequence: Synthetic peptide
GGGYSYGYDYGMDV

SEQ ID NO: 9011 - DNA, 51 bp, Artificial Sequence
  Description of Artificial Sequence: Synthetic oligonucleotide
gatgggggcagtggctggttccctaaactactacactacggtctggacgtc

SEQ ID NO: 9012 - protein, 17 aa, Artificial Sequence
  Description of Artificial Sequence: Synthetic peptide
DGGSGWFPKLLHYGLDV

SEQ ID NO: 9013 - DNA, 42 bp, Artificial Sequence
  Description of Artificial Sequence: Synthetic oligonucleotide
gggggtggctacagttatggttacgactatggtatggacgtc

SEQ ID NO: 9014 - protein, 14 aa, Artificial Sequence
  Description of Artificial Sequence: Synthetic peptide
GGGYSYGYDYGMDV

SEQ ID NO: 9015 - DNA, 33 bp, Artificial Sequence
  Description of Artificial Sequence: Synthetic oligonucleotide
cacctacgatattctgactggccccttgactac

SEQ ID NO: 9016 - protein, 11 aa, Artificial Sequence
  Description of Artificial Sequence: Synthetic peptide
HLRYSDWPLDY

SEQ ID NO: 9017 - DNA, 42 bp, Artificial Sequence
  Description of Artificial Sequence: Synthetic oligonucleotide
ggcggtggatacagcgatggttacgactacggtatggacgtc

SEQ ID NO: 9018 - protein, 14 aa, Artificial Sequence
  Description of Artificial Sequence: Synthetic peptide
GGGYSDGYDYGMDV

SEQ ID NO: 9019 - DNA, 42 bp, Artificial Sequence; identical to SEQ ID NO: 9017
  Description of Artificial Sequence: Synthetic oligonucleotide

SEQ ID NO: 9020 - protein, 14 aa, Artificial Sequence
  Description of Artificial Sequence: Synthetic peptide
GGGYSDGYDYGMDV

SEQ ID NO: 9021 - DNA, 42 bp, Artificial Sequence; identical to SEQ ID NO: 9009
  Description of Artificial Sequence: Synthetic oligonucleotide

SEQ ID NO: 9022 - protein, 14 aa, Artificial Sequence
  Description of Artificial Sequence: Synthetic peptide
GGGYSYGYDYGMDV

SEQ ID NO: 9023 - DNA, 42 bp, Artificial Sequence; identical to SEQ ID NO: 9009
  Description of Artificial Sequence: Synthetic oligonucleotide

SEQ ID NO: 9024 - protein, 14 aa, Artificial Sequence
  Description of Artificial Sequence: Synthetic peptide
GGGYSYGYDYGMDV

SEQ ID NO: 9025 - DNA, 36 bp, Artificial Sequence
  Description of Artificial Sequence: Synthetic oligonucleotide
ctggtaactccggactactactacggtatggacgtc

SEQ ID NO: 9026 - protein, 12 aa, Artificial Sequence
  Description of Artificial Sequence: Synthetic peptide
LVTPDYYYGMDV

SEQ ID NO: 9027 - DNA, 42 bp, Artificial Sequence; identical to SEQ ID NO: 9009
  Description of Artificial Sequence: Synthetic oligonucleotide

SEQ ID NO: 9028 - protein, 14 aa, Artificial Sequence
  Description of Artificial Sequence: Synthetic peptide
GGGYSYGYDYGMDV

SEQ ID NO: 9029 - DNA, 42 bp, Artificial Sequence; identical to SEQ ID NO: 8999
  Description of Artificial Sequence: Synthetic oligonucleotide

SEQ ID NO: 9030 - protein, 14 aa, Artificial Sequence
  Description of Artificial Sequence: Synthetic peptide
GGGYSNGYDYGMDV

SEQ ID NO: 9031 - DNA, 42 bp, Artificial Sequence
  Description of Artificial Sequence: Synthetic oligonucleotide
ggcggtggatacagccatggttacgactacggtatggacgtc

SEQ ID NO: 9032 - protein, 14 aa, Artificial Sequence
  Description of Artificial Sequence: Synthetic peptide
GGGYSHGYDYGMDV

SEQ ID NO: 9033 - DNA, 42 bp, Artificial Sequence; identical to SEQ ID NO: 9017
  Description of Artificial Sequence: Synthetic oligonucleotide

SEQ ID NO: 9034 - protein, 14 aa, Artificial Sequence
  Description of Artificial Sequence: Synthetic peptide
GGGYSDGYDYGMDV

SEQ ID NO: 9035 - DNA, 42 bp, Artificial Sequence; identical to SEQ ID NO: 9003
  Description of Artificial Sequence: Synthetic oligonucleotide

SEQ ID NO: 9036 - protein, 14 aa, Artificial Sequence
  Description of Artificial Sequence: Synthetic peptide
GGGYSHGYDYGMDV

SEQ ID NO: 9037 - DNA, 42 bp, Artificial Sequence; identical to SEQ ID NO: 9017
  Description of Artificial Sequence: Synthetic oligonucleotide

SEQ ID NO: 9038 - protein, 14 aa, Artificial Sequence
  Description of Artificial Sequence: Synthetic peptide
GGGYSDGYDYGMDV

SEQ ID NO: 9039 - DNA, 42 bp, Artificial Sequence; identical to SEQ ID NO: 9017
  Description of Artificial Sequence: Synthetic oligonucleotide

SEQ ID NO: 9040 - protein, 14 aa, Artificial Sequence
  Description of Artificial Sequence: Synthetic peptide
GGGYSDGYDYGMDV

SEQ ID NO: 9041 - DNA, 36 bp, Artificial Sequence
  Description of Artificial Sequence: Synthetic oligonucleotide
gtgatgactccggactactactacgatatggacgtc

SEQ ID NO: 9042 - protein, 12 aa, Artificial Sequence
  Description of Artificial Sequence: Synthetic peptide
VMTPDYYYDMDV

SEQ ID NO: 9043 - DNA, 36 bp, Artificial Sequence; identical to SEQ ID NO: 9041
  Description of Artificial Sequence: Synthetic oligonucleotide

SEQ ID NO: 9044 - protein, 12 aa, Artificial Sequence
  Description of Artificial Sequence: Synthetic peptide
VMTPDYYYDMDV

SEQ ID NO: 9045 - DNA, 42 bp, Artificial Sequence; identical to SEQ ID NO: 9009
  Description of Artificial Sequence: Synthetic oligonucleotide

SEQ ID NO: 9046 - protein, 14 aa, Artificial Sequence
  Description of Artificial Sequence: Synthetic peptide
GGGYSYGYDYGMDV

SEQ ID NO: 9047 - DNA, 48 bp, Artificial Sequence
  Description of Artificial Sequence: Synthetic oligonucleotide
gataaactatggttcgggaaattaaactactactacggtatggacgtc

SEQ ID NO: 9048 - protein, 16 aa, Artificial Sequence
  Description of Artificial Sequence: Synthetic peptide
DKLWFGKLNYYYGMDV

SEQ ID NO: 9049 - DNA, 42 bp, Artificial Sequence; identical to SEQ ID NO: 9009
  Description of Artificial Sequence: Synthetic oligonucleotide

SEQ ID NO: 9050 - protein, 14 aa, Artificial Sequence
  Description of Artificial Sequence: Synthetic peptide
GGGYSYGYDYGMDV

SEQ ID NO: 9051 - DNA, 42 bp, Artificial Sequence; identical to SEQ ID NO: 9009
  Description of Artificial Sequence: Synthetic oligonucleotide

SEQ ID NO: 9052 - protein, 14 aa, Artificial Sequence
  Description of Artificial Sequence: Synthetic peptide
GGGYSYGYDYGMDV

SEQ ID NO: 9053 - DNA, 36 bp, Artificial Sequence
  Description of Artificial Sequence: Synthetic oligonucleotide
atggtaactccggactactactacgatatggacgtc

SEQ ID NO: 9054 - protein, 12 aa, Artificial Sequence
  Description of Artificial Sequence: Synthetic peptide
MVTPDYYYDMDV

SEQ ID NO: 9055 - DNA, 42 bp, Artificial Sequence; identical to SEQ ID NO: 9017
  Description of Artificial Sequence: Synthetic oligonucleotide

SEQ ID NO: 9056 - protein, 14 aa, Artificial Sequence
  Description of Artificial Sequence: Synthetic peptide
GGGYSDGYDYGMDV

SEQ ID NO: 9057 - DNA, 42 bp, Artificial Sequence; identical to SEQ ID NO: 9009
  Description of Artificial Sequence: Synthetic oligonucleotide

SEQ ID NO: 9058 - protein, 14 aa, Artificial Sequence
  Description of Artificial Sequence: Synthetic peptide
GGGYSYGYDYGMDV

SEQ ID NO: 9059 - DNA, 42 bp, Artificial Sequence; identical to SEQ ID NO: 9017
  Description of Artificial Sequence: Synthetic oligonucleotide

SEQ ID NO: 9060 - protein, 14 aa, Artificial Sequence
  Description of Artificial Sequence: Synthetic peptide
GGGYSDGYDYGMDV

SEQ ID NO: 9061 - DNA, 42 bp, Artificial Sequence; identical to SEQ ID NO: 9001
  Description of Artificial Sequence: Synthetic oligonucleotide

SEQ ID NO: 9062 - protein, 14 aa, Artificial Sequence
  Description of Artificial Sequence: Synthetic peptide
GGGYSYGYDYGMDV

SEQ ID NO: 9063 - DNA, 51 bp, Artificial Sequence
  Description of Artificial Sequence: Synthetic oligonucleotide
aactatggttcggggagttatggggcctactactaccacggtatggacgtc

SEQ ID NO: 9064 - protein, 17 aa, Artificial Sequence
  Description of Artificial Sequence: Synthetic peptide
NYGSGSYGAYYYHGMDV

SEQ ID NO: 9065 - DNA, 36 bp, Artificial Sequence
  Description of Artificial Sequence: Synthetic oligonucleotide
ggctggggaacctactactactacggtatggacgtc

SEQ ID NO: 9066 - protein, 12 aa, Artificial Sequence
  Description of Artificial Sequence: Synthetic peptide
GWGTYYYYGMDV

SEQ ID NO: 9067 - DNA, 36 bp, Artificial Sequence
  Description of Artificial Sequence: Synthetic oligonucleotide
ggctggggaaggtactattcctacggtatggacgtc

SEQ ID NO: 9068 - protein, 12 aa, Artificial Sequence
  Description of Artificial Sequence: Synthetic peptide
GWGRYYSYGMDV

SEQ ID NO: 9069 - DNA, 33 bp, Artificial Sequence; identical to SEQ ID NO: 9005
  Description of Artificial Sequence: Synthetic oligonucleotide

SEQ ID NO: 9070 - protein, 11 aa, Artificial Sequence
  Description of Artificial Sequence: Synthetic peptide
HLRYFDWPLDY

SEQ ID NO: 9071 - DNA, 36 bp, Artificial Sequence
  Description of Artificial Sequence: Synthetic oligonucleotide
agtaaagcagctcgtccggacgacggtatggacgtc

SEQ ID NO: 9072 - protein, 12 aa, Artificial Sequence
  Description of Artificial Sequence: Synthetic peptide
SKAARPDDGMDV

SEQ ID NO: 9073 - DNA, 51 bp, Artificial Sequence; identical to SEQ ID NO: 9011
  Description of Artificial Sequence: Synthetic oligonucleotide

SEQ ID NO: 9074 - protein, 17 aa, Artificial Sequence
  Description of Artificial Sequence: Synthetic peptide
DGGSGWFPKLLHYGLDV

SEQ ID NO: 9075 - DNA, 51 bp, Artificial Sequence
  Description of Artificial Sequence: Synthetic oligonucleotide
aactatggttcggggagttatggggcctactactaccacggaatggacgtc

SEQ ID NO: 9076 - protein, 17 aa, Artificial Sequence
  Description of Artificial Sequence: Synthetic peptide
NYGSGSYGAYYYHGMDV

SEQ ID NO: 9077 - DNA, 36 bp, Artificial Sequence
  Description of Artificial Sequence: Synthetic oligonucleotide
gagcagtggcccaactactactacggtttgggcgtc

SEQ ID NO: 9078 - protein, 12 aa, Artificial Sequence
  Description of Artificial Sequence: Synthetic peptide
EQWPNYYYGLGV

SEQ ID NO: 9079 - DNA, 36 bp, Artificial Sequence
  Description of Artificial Sequence: Synthetic oligonucleotide
ggctggggaaggttctattcctacggtatggacgtc

SEQ ID NO: 9080 - protein, 12 aa, Artificial Sequence
  Description of Artificial Sequence: Synthetic peptide
GWGRFYSYGMDV

SEQ ID NO: 9081 - DNA, 36 bp, Artificial Sequence; identical to SEQ ID NO: 9065
  Description of Artificial Sequence: Synthetic oligonucleotide

SEQ ID NO: 9082 - protein, 12 aa, Artificial Sequence
  Description of Artificial Sequence: Synthetic peptide
GWGTYYYYGMDV

SEQ ID NO: 9083 - DNA, 48 bp, Artificial Sequence
  Description of Artificial Sequence: Synthetic oligonucleotide
gatttactatggttcgggaagttaaactactactacggtatggacgtc

SEQ ID NO: 9084 - protein, 16 aa, Artificial Sequence
  Description of Artificial Sequence: Synthetic peptide
DLLWFGKLNYYYGMDV

SEQ ID NO: 9085 - DNA, 36 bp, Artificial Sequence; identical to SEQ ID NO: 9041
  Description of Artificial Sequence: Synthetic oligonucleotide

SEQ ID NO: 9086 - protein, 12 aa, Artificial Sequence
  Description of Artificial Sequence: Synthetic peptide
VMTPDYYYDMDV

SEQ ID NO: 9087 - DNA, 33 bp, Artificial Sequence
  Description of Artificial Sequence: Synthetic oligonucleotide
gggatttttggagtgattacgtactttgactac

SEQ ID NO: 9088 - protein, 11 aa, Artificial Sequence
  Description of Artificial Sequence: Synthetic peptide
GIFGVITYFDY

SEQ ID NO: 9089 - DNA, 48 bp, Artificial Sequence
  Description of Artificial Sequence: Synthetic oligonucleotide
gaggtactatggttcgggaagttaaactactactacggtatggacgtc

SEQ ID NO: 9090 - protein, 16 aa, Artificial Sequence
  Description of Artificial Sequence: Synthetic peptide
EVLWFGKLNYYYGMDV

SEQ ID NO: 9091 - DNA, 33 bp, Artificial Sequence
  Description of Artificial Sequence: Synthetic oligonucleotide
acgatttttggagtggtaggatggttcgacccc

SEQ ID NO: 9092 - protein, 11 aa, Artificial Sequence
  Description of Artificial Sequence: Synthetic peptide
TIFGVVGWFDP

SEQ ID NO: 9093 - DNA, 39 bp, Artificial Sequence
  Description of Artificial Sequence: Synthetic oligonucleotide
agacggtataactggaactacgagaactggttcgacccc

SEQ ID NO: 9094 - protein, 13 aa, Artificial Sequence
  Description of Artificial Sequence: Synthetic peptide
RRYNWNYENWFDP

SEQ ID NO: 9095 - DNA, 45 bp, Artificial Sequence
  Description of Artificial Sequence: Synthetic oligonucleotide
ggggagggtatagcagctcggtactactactacggtatggacgtc

SEQ ID NO: 9096 - protein, 15 aa, Artificial Sequence
  Description of Artificial Sequence: Synthetic peptide
GEGIAARYYYYGMDV

SEQ ID NO: 9097 - DNA, 51 bp, Artificial Sequence; identical to SEQ ID NO: 9075
  Description of Artificial Sequence: Synthetic oligonucleotide

SEQ ID NO: 9098 - protein, 17 aa, Artificial Sequence
  Description of Artificial Sequence: Synthetic peptide
NYGSGSYGAYYYHGMDV

SEQ ID NO: 9099 - DNA, 33 bp, Artificial Sequence; identical to SEQ ID NO: 9015
  Description of Artificial Sequence: Synthetic oligonucleotide

SEQ ID NO: 9100 - protein, 11 aa, Artificial Sequence
  Description of Artificial Sequence: Synthetic peptide
HLRYSDWPLDY

SEQ ID NO: 9101 - DNA, 36 bp, Artificial Sequence; identical to SEQ ID NO: 9065
  Description of Artificial Sequence: Synthetic oligonucleotide

SEQ ID NO: 9102 - protein, 12 aa, Artificial Sequence
  Description of Artificial Sequence: Synthetic peptide
GWGTYYYYGMDV

SEQ ID NO: 9103 - DNA, 33 bp, Artificial Sequence; identical to SEQ ID NO: 9005
  Description of Artificial Sequence: Synthetic oligonucleotide

SEQ ID NO: 9104 - protein, 11 aa, Artificial Sequence
  Description of Artificial Sequence: Synthetic peptide
HLRYFDWPLDY

SEQ ID NO: 9105 - DNA, 42 bp, Artificial Sequence; identical to SEQ ID NO: 9009
  Description of Artificial Sequence: Synthetic oligonucleotide

SEQ ID NO: 9106 - protein, 14 aa, Artificial Sequence
  Description of Artificial Sequence: Synthetic peptide
GGGYSYGYDYGMDV

SEQ ID NO: 9107 - DNA, 33 bp, Artificial Sequence; identical to SEQ ID NO: 9091
  Description of Artificial Sequence: Synthetic oligonucleotide

SEQ ID NO: 9108 - protein, 11 aa, Artificial Sequence
  Description of Artificial Sequence: Synthetic peptide
TIFGVVGWFDP

SEQ ID NO: 9109 - DNA, 39 bp, Artificial Sequence
  Description of Artificial Sequence: Synthetic oligonucleotide
agacggtataactggaactacgaaaactggttcgacccc

SEQ ID NO: 9110 - protein, 13 aa, Artificial Sequence
  Description of Artificial Sequence: Synthetic peptide
RRYNWNYENWFDP

SEQ ID NO: 9111 - DNA, 39 bp, Artificial Sequence; identical to SEQ ID NO: 9093
  Description of Artificial Sequence: Synthetic oligonucleotide

SEQ ID NO: 9112 - protein, 13 aa, Artificial Sequence
  Description of Artificial Sequence: Synthetic peptide
RRYNWNYENWFDP

SEQ ID NO: 9113 - DNA, 36 bp, Artificial Sequence
  Description of Artificial Sequence: Synthetic oligonucleotide
actttaacccctgactactactacgatatggacgtc

SEQ ID NO: 9114 - protein, 12 aa, Artificial Sequence
  Description of Artificial Sequence: Synthetic peptide
TLTPDYYYDMDV

SEQ ID NO: 9115 - DNA, 36 bp, Artificial Sequence
  Description of Artificial Sequence: Synthetic oligonucleotide
gctttaacccctgactactactacgatatggacgtc

SEQ ID NO: 9116 - protein, 12 aa, Artificial Sequence
  Description of Artificial Sequence: Synthetic peptide
ALTPDYYYDMDV

SEQ ID NO: 9117 - DNA, 48 bp, Artificial Sequence
  Description of Artificial Sequence: Synthetic oligonucleotide
caggggggtatagcagcagcttactactactacgacggtatggacgtc

SEQ ID NO: 9118 - protein, 16 aa, Artificial Sequence
  Description of Artificial Sequence: Synthetic peptide
QGGIAAAYYYYDGMDV

SEQ ID NO: 9119 - DNA, 51 bp, Artificial Sequence
  Description of Artificial Sequence: Synthetic oligonucleotide
aactatggttcggggagttatggggcctactactactacggtatggacgtc

SEQ ID NO: 9120 - protein, 17 aa, Artificial Sequence
  Description of Artificial Sequence: Synthetic peptide
NYGSGSYGAYYYYGMDV

SEQ ID NO: 9121 - DNA, 51 bp, Artificial Sequence; identical to SEQ ID NO: 9011
  Description of Artificial Sequence: Synthetic oligonucleotide

SEQ ID NO: 9122 - protein, 17 aa, Artificial Sequence
  Description of Artificial Sequence: Synthetic peptide
DGGSGWFPKLLHYGLDV

SEQ ID NO: 9123 - DNA, 45 bp, Artificial Sequence
  Description of Artificial Sequence: Synthetic oligonucleotide
ggggagggtatatcagctcggtactactactacggtatggacgtc

SEQ ID NO: 9124 - protein, 15 aa, Artificial Sequence
  Description of Artificial Sequence: Synthetic peptide
GEGISARYYYYGMDV

SEQ ID NO: 9125 - DNA, 48 bp, Artificial Sequence
  Description of Artificial Sequence: Synthetic oligonucleotide
gatcgtctttggttcggagtgttaaactactactacggtatggacgtc

SEQ ID NO: 9126 - protein, 16 aa, Artificial Sequence
  Description of Artificial Sequence: Synthetic peptide
DRLWFGVLNYYYGMDV

SEQ ID NO: 9127 - DNA, 48 bp, Artificial Sequence
  Description of Artificial Sequence: Synthetic oligonucleotide
gagaagatgtggttcggggtgttaaactactactacggtatggacgtc

SEQ ID NO: 9128 - protein, 16 aa, Artificial Sequence
  Description of Artificial Sequence: Synthetic peptide
EKMWFGVLNYYYGMDV

SEQ ID NO: 9129 - DNA, 48 bp, Artificial Sequence
  Description of Artificial Sequence: Synthetic oligonucleotide
gatcgtctatggttcggagtgttaaactactactacggtatggacgtc

SEQ ID NO: 9130 - protein, 16 aa, Artificial Sequence
  Description of Artificial Sequence: Synthetic peptide
DRLWFGVLNYYYGMDV

SEQ ID NO: 9131 - DNA, 48 bp, Artificial Sequence
  Description of Artificial Sequence: Synthetic oligonucleotide
gatcaactatggttcggggttttaaactactattacggtatggacgtc

SEQ ID NO: 9132 - protein, 16 aa, Artificial Sequence
  Description of Artificial Sequence: Synthetic peptide
DQLWFGVLNYYYGMDV

SEQ ID NO: 9133 - DNA, 48 bp, Artificial Sequence
  Description of Artificial Sequence: Synthetic oligonucleotide
ccatcgaatagtgggagctattataattacttctccgttatggacgtc

SEQ ID NO: 9134 - protein, 16 aa, Artificial Sequence
  Description of Artificial Sequence: Synthetic peptide
PSNSGSYYNYFSVMDV

SEQ ID NO: 9135 - DNA, 48 bp, Artificial Sequence; identical to SEQ ID NO: 9133
  Description of Artificial Sequence: Synthetic oligonucleotide

SEQ ID NO: 9136 - protein, 16 aa, Artificial Sequence
  Description of Artificial Sequence: Synthetic peptide
PSNSGSYYNYFSVMDV

SEQ ID NO: 9137 - DNA, 48 bp, Artificial Sequence; identical to SEQ ID NO: 9129
  Description of Artificial Sequence: Synthetic oligonucleotide

SEQ ID NO: 9138 - protein, 16 aa, Artificial Sequence
  Description of Artificial Sequence: Synthetic peptide
DRLWFGVLNYYYGMDV

SEQ ID NO: 9139 - DNA, 48 bp, Artificial Sequence; identical to SEQ ID NO: 9131
  Description of Artificial Sequence: Synthetic oligonucleotide

SEQ ID NO: 9140 - protein, 16 aa, Artificial Sequence
  Description of Artificial Sequence: Synthetic peptide
DQLWFGVLNYYYGMDV

SEQ ID NO: 9141 - DNA, 48 bp, Artificial Sequence; identical to SEQ ID NO: 9127
  Description of Artificial Sequence: Synthetic oligonucleotide

SEQ ID NO: 9142 - protein, 16 aa, Artificial Sequence
  Description of Artificial Sequence: Synthetic peptide
EKMWFGVLNYYYGMDV

SEQ ID NO: 9143 - DNA, 48 bp, Artificial Sequence; identical to SEQ ID NO: 9129
  Description of Artificial Sequence: Synthetic oligonucleotide

SEQ ID NO: 9144 - protein, 16 aa, Artificial Sequence
  Description of Artificial Sequence: Synthetic peptide
DRLWFGVLNYYYGMDV

SEQ ID NO: 9145 - DNA, 48 bp, Artificial Sequence; identical to SEQ ID NO: 9133
  Description of Artificial Sequence: Synthetic oligonucleotide

SEQ ID NO: 9146 - protein, 16 aa, Artificial Sequence
  Description of Artificial Sequence: Synthetic peptide
PSNSGSYYNYFSVMDV

SEQ ID NO: 9147 - DNA, 48 bp, Artificial Sequence
  Description of Artificial Sequence: Synthetic oligonucleotide
ccttcgtatagtgggagctattataattacttctccgttatggacgtc

SEQ ID NO: 9148 - protein, 16 aa, Artificial Sequence
  Description of Artificial Sequence: Synthetic peptide
PSYSGSYYNYFSVMDV

SEQ ID NO: 9149 - DNA, 48 bp, Artificial Sequence; identical to SEQ ID NO: 9133
  Description of Artificial Sequence: Synthetic oligonucleotide

SEQ ID NO: 9150 - protein, 16 aa, Artificial Sequence
  Description of Artificial Sequence: Synthetic peptide
PSNSGSYYNYFSVMDV

SEQ ID NO: 9151 - DNA, 48 bp, Artificial Sequence; identical to SEQ ID NO: 9127
  Description of Artificial Sequence: Synthetic oligonucleotide

SEQ ID NO: 9152 - protein, 16 aa, Artificial Sequence
  Description of Artificial Sequence: Synthetic peptide
EKMWFGVLNYYYGMDV

SEQ ID NO: 9153 - DNA, 48 bp, Artificial Sequence; identical to SEQ ID NO: 9125
  Description of Artificial Sequence: Synthetic oligonucleotide

SEQ ID NO: 9154 - protein, 16 aa, Artificial Sequence
  Description of Artificial Sequence: Synthetic peptide
DRLWFGVLNYYYGMDV

SEQ ID NO: 9155 - DNA, 48 bp, Artificial Sequence; identical to SEQ ID NO: 9131
  Description of Artificial Sequence: Synthetic oligonucleotide

SEQ ID NO: 9156 - protein, 16 aa, Artificial Sequence
  Description of Artificial Sequence: Synthetic peptide
DQLWFGVLNYYYGMDV

SEQ ID NO: 9157 - DNA, 48 bp, Artificial Sequence; identical to SEQ ID NO: 9127
  Description of Artificial Sequence: Synthetic oligonucleotide

SEQ ID NO: 9158 - protein, 16 aa, Artificial Sequence
  Description of Artificial Sequence: Synthetic peptide
EKMWFGVLNYYYGMDV

SEQ ID NO: 9159 - DNA, 48 bp, Artificial Sequence; identical to SEQ ID NO: 9131
  Description of Artificial Sequence: Synthetic oligonucleotide

SEQ ID NO: 9160 - protein, 16 aa, Artificial Sequence
  Description of Artificial Sequence: Synthetic peptide
DQLWFGVLNYYYGMDV

SEQ ID NO: 9161 - DNA, 48 bp, Artificial Sequence
  Description of Artificial Sequence: Synthetic oligonucleotide
gatttactttggttcgggaagcttaactactactacggtttggacgtc

SEQ ID NO: 9162 - protein, 16 aa, Artificial Sequence
  Description of Artificial Sequence: Synthetic peptide
DLLWFGKLNYYYGLDV

SEQ ID NO: 9163 - DNA, 48 bp, Artificial Sequence; identical to SEQ ID NO: 9161
  Description of Artificial Sequence: Synthetic oligonucleotide

SEQ ID NO: 9164 - protein, 16 aa, Artificial Sequence
  Description of Artificial Sequence: Synthetic peptide
DLLWFGKLNYYYGLDV

SEQ ID NO: 9165 - DNA, 48 bp, Artificial Sequence; identical to SEQ ID NO: 9127
  Description of Artificial Sequence: Synthetic oligonucleotide

SEQ ID NO: 9166 - protein, 16 aa, Artificial Sequence
  Description of Artificial Sequence: Synthetic peptide
EKMWFGVLNYYYGMDV

SEQ ID NO: 9167 - DNA, 48 bp, Artificial Sequence; identical to SEQ ID NO: 9129
  Description of Artificial Sequence: Synthetic oligonucleotide

SEQ ID NO: 9168 - protein, 16 aa, Artificial Sequence
  Description of Artificial Sequence: Synthetic peptide
DRLWFGVLNYYYGMDV

SEQ ID NO: 9169 - DNA, 48 bp, Artificial Sequence; identical to SEQ ID NO: 9129
  Description of Artificial Sequence: Synthetic oligonucleotide

SEQ ID NO: 9170 - protein, 16 aa, Artificial Sequence
  Description of Artificial Sequence: Synthetic peptide
DRLWFGVLNYYYGMDV

SEQ ID NO: 9171 - DNA, 48 bp, Artificial Sequence
  Description of Artificial Sequence: Synthetic oligonucleotide
ccatcgaatggtgggagctattataattacttctccgttatggacgtc

SEQ ID NO: 9172 - protein, 16 aa, Artificial Sequence
  Description of Artificial Sequence: Synthetic peptide
PSNGGSYYNYFSVMDV

SEQ ID NO: 9173 - DNA, 48 bp, Artificial Sequence; identical to SEQ ID NO: 9127
  Description of Artificial Sequence: Synthetic oligonucleotide

SEQ ID NO: 9174 - protein, 16 aa, Artificial Sequence
  Description of Artificial Sequence: Synthetic peptide
EKMWFGVLNYYYGMDV

SEQ ID NO: 9175 - DNA, 30 bp, Artificial Sequence
  Description of Artificial Sequence: Synthetic oligonucleotide
ggaaagggagtacatctgggctttgactac

SEQ ID NO: 9176 - protein, 10 aa, Artificial Sequence
  Description of Artificial Sequence: Synthetic peptide
GKGVHLGFDY

SEQ ID NO: 9177 - DNA, 30 bp, Artificial Sequence
  Description of Artificial Sequence: Synthetic oligonucleotide
ggaaagggagtacatctgaactttgactac

SEQ ID NO: 9178 - protein, 10 aa, Artificial Sequence
  Description of Artificial Sequence: Synthetic peptide
GKGVHLNFDY

SEQ ID NO: 9179 - DNA, 30 bp, Artificial Sequence; identical to SEQ ID NO: 9175
  Description of Artificial Sequence: Synthetic oligonucleotide

SEQ ID NO: 9180 - protein, 10 aa, Artificial Sequence
  Description of Artificial Sequence: Synthetic peptide
GKGVHLGFDY

SEQ ID NO: 9181 - DNA, 30 bp, Artificial Sequence; identical to SEQ ID NO: 9175
  Description of Artificial Sequence: Synthetic oligonucleotide

SEQ ID NO: 9182 - protein, 10 aa, Artificial Sequence
  Description of Artificial Sequence: Synthetic peptide
GKGVHLGFDY

SEQ ID NO: 9183 - DNA, 30 bp, Artificial Sequence; identical to SEQ ID NO: 9175
  Description of Artificial Sequence: Synthetic oligonucleotide

SEQ ID NO: 9184 - protein, 10 aa, Artificial Sequence
  Description of Artificial Sequence: Synthetic peptide
GKGVHLGFDY

SEQ ID NO: 9185 - DNA, 30 bp, Artificial Sequence; identical to SEQ ID NO: 9175
  Description of Artificial Sequence: Synthetic oligonucleotide

SEQ ID NO: 9186 - protein, 10 aa, Artificial Sequence
  Description of Artificial Sequence: Synthetic peptide
GKGVHLGFDY

SEQ ID NO: 9187 - DNA, 30 bp, Artificial Sequence; identical to SEQ ID NO: 9175
  Description of Artificial Sequence: Synthetic oligonucleotide

SEQ ID NO: 9188 - protein, 10 aa, Artificial Sequence
  Description of Artificial Sequence: Synthetic peptide
GKGVHLGFDY

SEQ ID NO: 9189 - DNA, 30 bp, Artificial Sequence; identical to SEQ ID NO: 9175
  Description of Artificial Sequence: Synthetic oligonucleotide

SEQ ID NO: 9190 - protein, 10 aa, Artificial Sequence
  Description of Artificial Sequence: Synthetic peptide
GKGVHLGFDY

SEQ ID NO: 9191 - DNA, 30 bp, Artificial Sequence; identical to SEQ ID NO: 9175
  Description of Artificial Sequence: Synthetic oligonucleotide

SEQ ID NO: 9192 - protein, 10 aa, Artificial Sequence
  Description of Artificial Sequence: Synthetic peptide
GKGVHLGFDY

SEQ ID NO: 9193 - DNA, 30 bp, Artificial Sequence
  Description of Artificial Sequence: Synthetic oligonucleotide
ggaaagggagtacatctgggctttgaccac

SEQ ID NO: 9194 - protein, 10 aa, Artificial Sequence
  Description of Artificial Sequence: Synthetic peptide
GKGVHLGFDH

SEQ ID NO: 9195 - DNA, 30 bp, Artificial Sequence; identical to SEQ ID NO: 9177
  Description of Artificial Sequence: Synthetic oligonucleotide

SEQ ID NO: 9196 - protein, 10 aa, Artificial Sequence
  Description of Artificial Sequence: Synthetic peptide
GKGVHLNFDY

SEQ ID NO: 9197 - DNA, 30 bp, Artificial Sequence; identical to SEQ ID NO: 9175
  Description of Artificial Sequence: Synthetic oligonucleotide

SEQ ID NO: 9198 - protein, 10 aa, Artificial Sequence
  Description of Artificial Sequence: Synthetic peptide
GKGVHLGFDY

SEQ ID NO: 9199 - DNA, 30 bp, Artificial Sequence; identical to SEQ ID NO: 9175
  Description of Artificial Sequence: Synthetic oligonucleotide

SEQ ID NO: 9200 - protein, 10 aa, Artificial Sequence
  Description of Artificial Sequence: Synthetic peptide
GKGVHLGFDY

SEQ ID NO: 9201 - DNA, 30 bp, Artificial Sequence; identical to SEQ ID NO: 9175
  Description of Artificial Sequence: Synthetic oligonucleotide

SEQ ID NO: 9202 - protein, 10 aa, Artificial Sequence
  Description of Artificial Sequence: Synthetic peptide
GKGVHLGFDY

SEQ ID NO: 9203 - DNA, 30 bp, Artificial Sequence; identical to SEQ ID NO: 9177
  Description of Artificial Sequence: Synthetic oligonucleotide

SEQ ID NO: 9204 - protein, 10 aa, Artificial Sequence
  Description of Artificial Sequence: Synthetic peptide
GKGVHLNFDY

SEQ ID NO: 9205 - DNA, 30 bp, Artificial Sequence; identical to SEQ ID NO: 9175
  Description of Artificial Sequence: Synthetic oligonucleotide

SEQ ID NO: 9206 - protein, 10 aa, Artificial Sequence
  Description of Artificial Sequence: Synthetic peptide
GKGVHLGFDY

SEQ ID NO: 9207 - DNA, 30 bp, Artificial Sequence; identical to SEQ ID NO: 9175
  Description of Artificial Sequence: Synthetic oligonucleotide

SEQ ID NO: 9208 - protein, 10 aa, Artificial Sequence
  Description of Artificial Sequence: Synthetic peptide
GKGVHLGFDY

SEQ ID NO: 9209 - DNA, 30 bp, Artificial Sequence; identical to SEQ ID NO: 9177
  Description of Artificial Sequence: Synthetic oligonucleotide

SEQ ID NO: 9210 - protein, 10 aa, Artificial Sequence
  Description of Artificial Sequence: Synthetic peptide
GKGVHLNFDY

SEQ ID NO: 9211 - DNA, 30 bp, Artificial Sequence; identical to SEQ ID NO: 9175
  Description of Artificial Sequence: Synthetic oligonucleotide

SEQ ID NO: 9212 - protein, 10 aa, Artificial Sequence
  Description of Artificial Sequence: Synthetic peptide
GKGVHLGFDY

SEQ ID NO: 9213 - DNA, 30 bp, Artificial Sequence; identical to SEQ ID NO: 9177
  Description of Artificial Sequence: Synthetic oligonucleotide

SEQ ID NO: 9214 - protein, 10 aa, Artificial Sequence
  Description of Artificial Sequence: Synthetic peptide
GKGVHLNFDY

SEQ ID NO: 9215 - DNA, 30 bp, Artificial Sequence; identical to SEQ ID NO: 9177
  Description of Artificial Sequence: Synthetic oligonucleotide

SEQ ID NO: 9216 - protein, 10 aa, Artificial Sequence
  Description of Artificial Sequence: Synthetic peptide
GKGVHLNFDY

SEQ ID NO: 9217 - DNA, 30 bp, Artificial Sequence; identical to SEQ ID NO: 9175
  Description of Artificial Sequence: Synthetic oligonucleotide

SEQ ID NO: 9218 - protein, 10 aa, Artificial Sequence
  Description of Artificial Sequence: Synthetic peptide
GKGVHLGFDY

SEQ ID NO: 9219 - DNA, 30 bp, Artificial Sequence; identical to SEQ ID NO: 9175
  Description of Artificial Sequence: Synthetic oligonucleotide

SEQ ID NO: 9220 - protein, 10 aa, Artificial Sequence
  Description of Artificial Sequence: Synthetic peptide
GKGVHLGFDY

SEQ ID NO: 9221 - DNA, 30 bp, Artificial Sequence; identical to SEQ ID NO: 9175
  Description of Artificial Sequence: Synthetic oligonucleotide

SEQ ID NO: 9222 - protein, 10 aa, Artificial Sequence
  Description of Artificial Sequence: Synthetic peptide
GKGVHLGFDY

SEQ ID NO: 9223 - DNA, 30 bp, Artificial Sequence; identical to SEQ ID NO: 9175
  Description of Artificial Sequence: Synthetic oligonucleotide

SEQ ID NO: 9224 - protein, 10 aa, Artificial Sequence
  Description of Artificial Sequence: Synthetic peptide
GKGVHLGFDY

SEQ ID NO: 9225 - DNA, 30 bp, Artificial Sequence; identical to SEQ ID NO: 9177
  Description of Artificial Sequence: Synthetic oligonucleotide

SEQ ID NO: 9226 - protein, 10 aa, Artificial Sequence
  Description of Artificial Sequence: Synthetic peptide
GKGVHLNFDY

SEQ ID NO: 9227 - DNA, 30 bp, Artificial Sequence; identical to SEQ ID NO: 9177
  Description of Artificial Sequence: Synthetic oligonucleotide

SEQ ID NO: 9228 - protein, 10 aa, Artificial Sequence
  Description of Artificial Sequence: Synthetic peptide
GKGVHLNFDY

SEQ ID NO: 9229 - DNA, 30 bp, Artificial Sequence; identical to SEQ ID NO: 9175
  Description of Artificial Sequence: Synthetic oligonucleotide

SEQ ID NO: 9230 - protein, 10 aa, Artificial Sequence
  Description of Artificial Sequence: Synthetic peptide
GKGVHLGFDY

SEQ ID NO: 9231 - DNA, 30 bp, Artificial Sequence; identical to SEQ ID NO: 9175
  Description of Artificial Sequence: Synthetic oligonucleotide

SEQ ID NO: 9232 - protein, 10 aa, Artificial Sequence
  Description of Artificial Sequence: Synthetic peptide
GKGVHLGFDY

SEQ ID NO: 9233 - DNA, 30 bp, Artificial Sequence; identical to SEQ ID NO: 9175
  Description of Artificial Sequence: Synthetic oligonucleotide

SEQ ID NO: 9234 - protein, 10 aa, Artificial Sequence
  Description of Artificial Sequence: Synthetic peptide
GKGVHLGFDY

SEQ ID NO: 9235 - DNA, 30 bp, Artificial Sequence; identical to SEQ ID NO: 9175
  Description of Artificial Sequence: Synthetic oligonucleotide

SEQ ID NO: 9236 - protein, 10 aa, Artificial Sequence
  Description of Artificial Sequence: Synthetic peptide
GKGVHLGFDY

SEQ ID NO: 9237 - DNA, 30 bp, Artificial Sequence; identical to SEQ ID NO: 9175
  Description of Artificial Sequence: Synthetic oligonucleotide

SEQ ID NO: 9238 - protein, 10 aa, Artificial Sequence
  Description of Artificial Sequence: Synthetic peptide
GKGVHLGFDY

SEQ ID NO: 9239 - DNA, 30 bp, Artificial Sequence; identical to SEQ ID NO: 9175
  Description of Artificial Sequence: Synthetic oligonucleotide

SEQ ID NO: 9240 - protein, 10 aa, Artificial Sequence
  Description of Artificial Sequence: Synthetic peptide
GKGVHLGFDY

SEQ ID NO: 9241 - DNA, 30 bp, Artificial Sequence; identical to SEQ ID NO: 9175
  Description of Artificial Sequence: Synthetic oligonucleotide

SEQ ID NO: 9242 - protein, 10 aa, Artificial Sequence
  Description of Artificial Sequence: Synthetic peptide
GKGVHLGFDY

SEQ ID NO: 9243 - DNA, 21 bp, Artificial Sequence
  Description of Artificial Sequence: Synthetic oligonucleotide
gggcagctgctgactgggtac

SEQ ID NO: 9244 - protein, 7 aa, Artificial Sequence
  Description of Artificial Sequence: Synthetic peptide
GQLLTGY

SEQ ID NO: 9245 - DNA, 21 bp, Artificial Sequence
  Description of Artificial Sequence: Synthetic oligonucleotide
ggaagggctacttttgactac

SEQ ID NO: 9246 - protein, 7 aa, Artificial Sequence
  Description of Artificial Sequence: Synthetic peptide
GRATFDY

SEQ ID NO: 9247 - DNA, 21 bp, Artificial Sequence
  Description of Artificial Sequence: Synthetic oligonucleotide
ggaagggctacttttgactac

SEQ ID NO: 9248 - protein, 7 aa, Artificial Sequence
  Description of Artificial Sequence: Synthetic peptide
GRATFDY

SEQ ID NO: 9249 - DNA, 24 bp, Artificial Sequence
  Description of Artificial Sequence: Synthetic oligonucleotide
tacaactatggtcactttgactac

SEQ ID NO: 9250 - protein, 8 aa, Artificial Sequence
  Description of Artificial Sequence: Synthetic peptide
YNYGHFDY

SEQ ID NO: 9251 - DNA, 30 bp, Artificial Sequence; identical to SEQ ID NO: 9175
  Description of Artificial Sequence: Synthetic oligonucleotide

SEQ ID NO: 9252 - protein, 10 aa, Artificial Sequence
  Description of Artificial Sequence: Synthetic peptide
GKGVHLGFDY

SEQ ID NO: 9253 - DNA, 30 bp, Artificial Sequence; identical to SEQ ID NO: 9175
  Description of Artificial Sequence: Synthetic oligonucleotide

SEQ ID NO: 9254 - protein, 10 aa, Artificial Sequence
  Description of Artificial Sequence: Synthetic peptide
GKGVHLGFDY

SEQ ID NO: 9255 - DNA, 30 bp, Artificial Sequence
  Description of Artificial Sequence: Synthetic oligonucleotide
gggaagggagttcatctgaactttgactac

SEQ ID NO: 9256 - protein, 10 aa, Artificial Sequence
  Description of Artificial Sequence: Synthetic peptide
GKGVHLNFDY

SEQ ID NO: 9257 - DNA, 30 bp, Artificial Sequence; identical to SEQ ID NO: 9175
  Description of Artificial Sequence: Synthetic oligonucleotide

SEQ ID NO: 9258 - protein, 10 aa, Artificial Sequence
  Description of Artificial Sequence: Synthetic peptide
GKGVHLGFDY

SEQ ID NO: 9259 - DNA, 30 bp, Artificial Sequence; identical to SEQ ID NO: 9175
  Description of Artificial Sequence: Synthetic oligonucleotide

SEQ ID NO: 9260 - protein, 10 aa, Artificial Sequence
  Description of Artificial Sequence: Synthetic peptide
GKGVHLGFDY

SEQ ID NO: 9261 - DNA, 30 bp, Artificial Sequence; identical to SEQ ID NO: 9175
  Description of Artificial Sequence: Synthetic oligonucleotide

SEQ ID NO: 9262 - protein, 10 aa, Artificial Sequence
  Description of Artificial Sequence: Synthetic peptide
GKGVHLGFDY

SEQ ID NO: 9263 - DNA, 30 bp, Artificial Sequence; identical to SEQ ID NO: 9255
  Description of Artificial Sequence: Synthetic oligonucleotide

SEQ ID NO: 9264 - protein, 10 aa, Artificial Sequence
  Description of Artificial Sequence: Synthetic peptide
GKGVHLNFDY

SEQ ID NO: 9265 - DNA, 30 bp, Artificial Sequence; identical to SEQ ID NO: 9177
  Description of Artificial Sequence: Synthetic oligonucleotide

SEQ ID NO: 9266 - protein, 10 aa, Artificial Sequence
  Description of Artificial Sequence: Synthetic peptide
GKGVHLNFDY

SEQ ID NO: 9267 - DNA, 30 bp, Artificial Sequence; identical to SEQ ID NO: 9175
  Description of Artificial Sequence: Synthetic oligonucleotide

SEQ ID NO: 9268 - protein, 10 aa, Artificial Sequence
  Description of Artificial Sequence: Synthetic peptide
GKGVHLGFDY

SEQ ID NO: 9269 - DNA, 30 bp, Artificial Sequence; identical to SEQ ID NO: 9175
  Description of Artificial Sequence: Synthetic oligonucleotide

SEQ ID NO: 9270 - protein, 10 aa, Artificial Sequence
  Description of Artificial Sequence: Synthetic peptide
GKGVHLGFDY

SEQ ID NO: 9271 - DNA, 30 bp, Artificial Sequence; identical to SEQ ID NO: 9175
  Description of Artificial Sequence: Synthetic oligonucleotide

SEQ ID NO: 9272 - protein, 10 aa, Artificial Sequence
  Description of Artificial Sequence: Synthetic peptide
GKGVHLGFDY

SEQ ID NO: 9273 - DNA, 30 bp, Artificial Sequence; identical to SEQ ID NO: 9175
  Description of Artificial Sequence: Synthetic oligonucleotide

SEQ ID NO: 9274 - protein, 10 aa, Artificial Sequence
  Description of Artificial Sequence: Synthetic peptide
GKGVHLGFDY

SEQ ID NO: 9275 - DNA, 33 bp, Artificial Sequence; identical to SEQ ID NO: 9087
  Description of Artificial Sequence: Synthetic oligonucleotide

SEQ ID NO: 9276 - protein, 11 aa, Artificial Sequence
  Description of Artificial Sequence: Synthetic peptide
GIFGVITYFDY

SEQ ID NO: 9277 - DNA, 33 bp, Artificial Sequence; identical to SEQ ID NO: 9087
  Description of Artificial Sequence: Synthetic oligonucleotide

SEQ ID NO: 9278 - protein, 11 aa, Artificial Sequence
  Description of Artificial Sequence: Synthetic peptide
GIFGVITYFDY

SEQ ID NO: 9279 - DNA, 39 bp, Artificial Sequence; identical to SEQ ID NO: 9093
  Description of Artificial Sequence: Synthetic oligonucleotide

SEQ ID NO: 9280 - protein, 13 aa, Artificial Sequence
  Description of Artificial Sequence: Synthetic peptide
RRYNWNYENWFDP

SEQ ID NO: 9281 - DNA, 39 bp, Artificial Sequence; identical to SEQ ID NO: 9093
  Description of Artificial Sequence: Synthetic oligonucleotide

SEQ ID NO: 9282 - protein, 13 aa, Artificial Sequence
  Description of Artificial Sequence: Synthetic peptide
RRYNWNYENWFDP

SEQ ID NO: 9283 - DNA, 39 bp, Artificial Sequence; identical to SEQ ID NO: 9093
  Description of Artificial Sequence: Synthetic oligonucleotide

SEQ ID NO: 9284 - protein, 13 aa, Artificial Sequence
  Description of Artificial Sequence: Synthetic peptide
RRYNWNYENWFDP

SEQ ID NO: 9285 - DNA, 39 bp, Artificial Sequence; identical to SEQ ID NO: 9093
  Description of Artificial Sequence: Synthetic oligonucleotide

SEQ ID NO: 9286 - protein, 13 aa, Artificial Sequence
  Description of Artificial Sequence: Synthetic peptide
RRYNWNYENWFDP

SEQ ID NO: 9287 - DNA, 39 bp, Artificial Sequence; identical to SEQ ID NO: 9093
  Description of Artificial Sequence: Synthetic oligonucleotide

SEQ ID NO: 9288 - protein, 13 aa, Artificial Sequence
  Description of Artificial Sequence: Synthetic peptide
RRYNWNYENWFDP

SEQ ID NO: 9289 - DNA, 39 bp, Artificial Sequence; identical to SEQ ID NO: 9093
  Description of Artificial Sequence: Synthetic oligonucleotide

SEQ ID NO: 9290 - protein, 13 aa, Artificial Sequence
  Description of Artificial Sequence: Synthetic peptide
RRYNWNYENWFDP

SEQ ID NO: 9291 - DNA, 51 bp, Artificial Sequence; identical to SEQ ID NO: 9011
  Description of Artificial Sequence: Synthetic oligonucleotide

SEQ ID NO: 9292 - protein, 17 aa, Artificial Sequence
  Description of Artificial Sequence: Synthetic peptide
DGGSGWFPKLLHYGLDV

SEQ ID NO: 9293 - DNA, 48 bp, Artificial Sequence; identical to SEQ ID NO: 9147
  Description of Artificial Sequence: Synthetic oligonucleotide

SEQ ID NO: 9294 - protein, 16 aa, Artificial Sequence
  Description of Artificial Sequence: Synthetic peptide
PSYSGSYYNYFSVMDV

SEQ ID NO: 9295 - DNA, 48 bp, Artificial Sequence; identical to SEQ ID NO: 9147
  Description of Artificial Sequence: Synthetic oligonucleotide

SEQ ID NO: 9296 - protein, 16 aa, Artificial Sequence
  Description of Artificial Sequence: Synthetic peptide
PSYSGSYYNYFSVMDV

SEQ ID NO: 9297 - DNA, 48 bp, Artificial Sequence; identical to SEQ ID NO: 9133
  Description of Artificial Sequence: Synthetic oligonucleotide

SEQ ID NO: 9298 - protein, 16 aa, Artificial Sequence
  Description of Artificial Sequence: Synthetic peptide
PSNSGSYYNYFSVMDV

SEQ ID NO: 9299 - DNA, 48 bp, Artificial Sequence; identical to SEQ ID NO: 9147
  Description of Artificial Sequence: Synthetic oligonucleotide

SEQ ID NO: 9300 - protein, 16 aa, Artificial Sequence
  Description of Artificial Sequence: Synthetic peptide
PSYSGSYYNYFSVMDV

SEQ ID NO: 9301 - DNA, 48 bp, Artificial Sequence; identical to SEQ ID NO: 9147
  Description of Artificial Sequence: Synthetic oligonucleotide

SEQ ID NO: 9302 - protein, 16 aa, Artificial Sequence
  Description of Artificial Sequence: Synthetic peptide
PSYSGSYYNYFSVMDV

SEQ ID NO: 9303 - DNA, 48 bp, Artificial Sequence; identical to SEQ ID NO: 9147
  Description of Artificial Sequence: Synthetic oligonucleotide

SEQ ID NO: 9304 - protein, 16 aa, Artificial Sequence
  Description of Artificial Sequence: Synthetic peptide
PSYSGSYYNYFSVMDV

SEQ ID NO: 9305 - DNA, 48 bp, Artificial Sequence; identical to SEQ ID NO: 9127
  Description of Artificial Sequence: Synthetic oligonucleotide

SEQ ID NO: 9306 - protein, 16 aa, Artificial Sequence
  Description of Artificial Sequence: Synthetic peptide
EKMWFGVLNYYYGMDV

SEQ ID NO: 9307 - DNA, 48 bp, Artificial Sequence; identical to SEQ ID NO: 9125
  Description of Artificial Sequence: Synthetic oligonucleotide

SEQ ID NO: 9308 - protein, 16 aa, Artificial Sequence
  Description of Artificial Sequence: Synthetic peptide
DRLWFGVLNYYYGMDV

SEQ ID NO: 9309 - DNA, 48 bp, Artificial Sequence; identical to SEQ ID NO: 9133
  Description of Artificial Sequence: Synthetic oligonucleotide

SEQ ID NO: 9310 - protein, 16 aa, Artificial Sequence
  Description of Artificial Sequence: Synthetic peptide
PSNSGSYYNYFSVMDV

SEQ ID NO: 9311 - DNA, 48 bp, Artificial Sequence; identical to SEQ ID NO: 9147
  Description of Artificial Sequence: Synthetic oligonucleotide

SEQ ID NO: 9312 - protein, 16 aa, Artificial Sequence
  Description of Artificial Sequence: Synthetic peptide
PSYSGSYYNYFSVMDV

SEQ ID NO: 9313 - DNA, 48 bp, Artificial Sequence; identical to SEQ ID NO: 9147
  Description of Artificial Sequence: Synthetic oligonucleotide

SEQ ID NO: 9314 - protein, 16 aa, Artificial Sequence
  Description of Artificial Sequence: Synthetic peptide
PSYSGSYYNYFSVMDV

SEQ ID NO: 9315 - DNA, 48 bp, Artificial Sequence; identical to SEQ ID NO: 9129
  Description of Artificial Sequence: Synthetic oligonucleotide

SEQ ID NO: 9316 - protein, 16 aa, Artificial Sequence
  Description of Artificial Sequence: Synthetic peptide
DRLWFGVLNYYYGMDV

SEQ ID NO: 9317 - DNA, 48 bp, Artificial Sequence; identical to SEQ ID NO: 9125
  Description of Artificial Sequence: Synthetic oligonucleotide

SEQ ID NO: 9318 - protein, 16 aa, Artificial Sequence
  Description of Artificial Sequence: Synthetic peptide
DRLWFGVLNYYYGMDV

SEQ ID NO: 9319 - DNA, 48 bp, Artificial Sequence; identical to SEQ ID NO: 9127
  Description of Artificial Sequence: Synthetic oligonucleotide

SEQ ID NO: 9320 - protein, 16 aa, Artificial Sequence
  Description of Artificial Sequence: Synthetic peptide
EKMWFGVLNYYYGMDV

SEQ ID NO: 9321 - DNA, 48 bp, Artificial Sequence; identical to SEQ ID NO: 9147
  Description of Artificial Sequence: Synthetic oligonucleotide

SEQ ID NO: 9322 - protein, 16 aa, Artificial Sequence
  Description of Artificial Sequence: Synthetic peptide
PSYSGSYYNYFSVMDV

SEQ ID NO: 9323 - protein, 10 aa, Artificial Sequence
  Description of Artificial Sequence: Synthetic peptide
GKGVHLGFDY

SEQ ID NO: 9324 - protein, 10 aa, Artificial Sequence
  Description of Artificial Sequence: Synthetic peptide
GKGVHLGFDY

SEQ ID NO: 9325 - protein, 7 aa, Artificial Sequence
  Description of Artificial Sequence: Synthetic peptide
GQLLTGY

SEQ ID NO: 9326 - protein, 8 aa, Artificial Sequence
  Description of Artificial Sequence: Synthetic peptide
YNYGHFDY

SEQ ID NO: 9327 - protein, 16 aa, Artificial Sequence
  Description of Artificial Sequence: Synthetic peptide
EKMWFGVLNYYYGMDV

SEQ ID NO: 9328 - protein, 11 aa, Artificial Sequence
  Description of Artificial Sequence: Synthetic peptide
GIFGVITYFDY

SEQ ID NO: 9329 - protein, 10 aa, Artificial Sequence
  Description of Artificial Sequence: Synthetic peptide
GKGVHLGFDY

SEQ ID NO: 9330 - protein, 10 aa, Artificial Sequence
  Description of Artificial Sequence: Synthetic peptide
GKGVHLGFDY

SEQ ID NO: 9331 - protein, 10 aa, Artificial Sequence
  Description of Artificial Sequence: Synthetic peptide
GKGVHLGFDY

SEQ ID NO: 9332 - protein, 10 aa, Artificial Sequence
  Description of Artificial Sequence: Synthetic peptide
GKGVHLGFDY

SEQ ID NO: 9333 - protein, 10 aa, Artificial Sequence
  Description of Artificial Sequence: Synthetic peptide
GKGVHLGFDY

SEQ ID NO: 9334 - protein, 10 aa, Artificial Sequence
  Description of Artificial Sequence: Synthetic peptide
GKGVHLGFDY

SEQ ID NO: 9335 - protein, 10 aa, Artificial Sequence
  Description of Artificial Sequence: Synthetic peptide
GKGVHLGFDY

SEQ ID NO: 9336 - protein, 10 aa, Artificial Sequence
  Description of Artificial Sequence: Synthetic peptide
GKGVHLGFDY

SEQ ID NO: 9337 - protein, 16 aa, Artificial Sequence
  Description of Artificial Sequence: Synthetic peptide
PSYSGSYYNYFSVMDV

SEQ ID NO: 9338 - protein, 13 aa, Artificial Sequence
  Description of Artificial Sequence: Synthetic peptide
RRYNWNYENWFDP

SEQ ID NO: 9339 - protein, 13 aa, Artificial Sequence
  Description of Artificial Sequence: Synthetic peptide
RRYNWNYENWFDP

SEQ ID NO: 9340 - protein, 13 aa, Artificial Sequence
  Description of Artificial Sequence: Synthetic peptide
RRYNWNYENWFDP

SEQ ID NO: 9341 - protein, 13 aa, Artificial Sequence
  Description of Artificial Sequence: Synthetic peptide
RRYNWNYENWFDP

SEQ ID NO: 9342 - protein, 16 aa, Artificial Sequence
  Description of Artificial Sequence: Synthetic peptide
PSYSGSYYNYFSVMDV

SEQ ID NO: 9343 - protein, 16 aa, Artificial Sequence
  Description of Artificial Sequence: Synthetic peptide
PSYSGSYYNYFSVMDV

SEQ ID NO: 9344 - protein, 16 aa, Artificial Sequence
  Description of Artificial Sequence: Synthetic peptide
PSYSGSYYNYFSVMDV

SEQ ID NO: 9345 - protein, 16 aa, Artificial Sequence
  Description of Artificial Sequence: Synthetic peptide
PSYSGSYYNYFSVMDV

SEQ ID NO: 9346 - protein, 10 aa, Artificial Sequence
  Description of Artificial Sequence: Synthetic peptide
GKGVHLGFDY

SEQ ID NO: 9347 - protein, 10 aa, Artificial Sequence
  Description of Artificial Sequence: Synthetic peptide
GKGVHLGFDY

SEQ ID NO: 9348 - protein, 16 aa, Artificial Sequence
  Description of Artificial Sequence: Synthetic peptide
PSYSGSYYNYFSVMDV

SEQ ID NO: 9349 - protein, 16 aa, Artificial Sequence
  Description of Artificial Sequence: Synthetic peptide
PSYSGSYYNYFSVMDV

SEQ ID NO: 9350 - protein, 7 aa, Artificial Sequence
  Description of Artificial Sequence: Synthetic peptide
GQLLTGY

SEQ ID NO: 9351 - DNA, 255 bp, Artificial Sequence
  Description of Artificial Sequence: Synthetic polynucleotide
gagctcgtgatgacacagtctccatcctccctagctgtgtccgttggagagaaaattactatgagctgcaagtccagtcagagccttttatatagtagcaatcaaaagaactacttggcctggtaccagcagaaaccagggcagtctcctaaactgctgatttactgggcatccactagggaatctggggtccctgatcgcttcacaggcagtggatctgggacagatttcactctcaccatcagcagtgtgaag

SEQ ID NO: 9352 - protein, 113 aa, Artificial Sequence; identical to SEQ ID NO: 5028
  Description of Artificial Sequence: Synthetic polypeptide

SEQ ID NO: 9353 - DNA, 255 bp, Artificial Sequence
  Description of Artificial Sequence: Synthetic polynucleotide
gagctcgtgctcacccagtctccagcaatcatgtctgcatctccagggcagaaagtcaccataacctgcagtgccagctcaaatgtaaattacatacactggtaccagcagaagctaggatcctcccccaaactctggatttatgacacatccaaactggctcctggagtccctgctcgcttcagtggcagtgggtctgggacctcttactctctcacaatcagcagcatggaggctgaagatgctgcctcttat

SEQ ID NO: 9354 - protein, 106 aa, Artificial Sequence; identical to SEQ ID NO: 5030
  Description of Artificial Sequence: Synthetic polypeptide

SEQ ID NO: 9355 - DNA, 255 bp, Artificial Sequence
  Description of Artificial Sequence: Synthetic polynucleotide
gagctccagatgacccagtctccagcctccctatctgcatctgtgggagaaactgtcaccatcacatgtcgagcaagtgggaatattcacaattatttagcttggtatcagcagaaacagggaaaatctcctcagctcctggtctataatgcaaaaaccttagcaggaggtgtgccatcaaggttcagtggcagtggatcaggcacacagttttctctgaagatcaacagcctgcagcctgaagattttgggagt

SEQ ID NO: 9356 - protein, 107 aa, Artificial Sequence; identical to SEQ ID NO: 5032
  Description of Artificial Sequence: Synthetic polypeptide

SEQ ID NO: 9357 - DNA, 255 bp, Artificial Sequence
  Description of Artificial Sequence: Synthetic polynucleotide
gagctcgtgatgacccagtctccactctccctgcccgtctcccctggagagccggcctccatctcctgcaggtctagtcagagcctcctgtatagtaatggatacaactatgtggattggtacttgcagaagccagggcagtctccacagctcctgatctatttgggttctaatcgggcctccggggtccctgacaggttcagtggcagtggatcaggcacagattttacactgaaaatcagcaaagtggaggct

SEQ ID NO: 9358 - protein, 112 aa, Artificial Sequence
  Description of Artificial Sequence: Synthetic polypeptide
ELVMTQSPLSLPVSPGEPASISCRSSQSLLYSNGYNYVDWYLQKPGQSPQLLIYLGSNRASGVPDRFSGSGSGTDFTLKISKVEAEDVGVYYCMQALQTPPTFGQGTRLEIK

SEQ ID NO: 9359 - DNA, 255 bp, Artificial Sequence
  Description of Artificial Sequence: Synthetic polynucleotide
gagctcgtgatgacccagtctccactctccctgcccgtcacccctggagagccggcctccatctcctgcaggtctagtcagagcctcctgtatagtaatggataccactatttggattggtacctgcagaagccaggacagtctccacagctcctgatctatttgggttctatccgggcctccggggtccctgacaggttcagtggcagtggatcaggcacagattttacactgaaaatcagcagagtggaggct

SEQ ID NO: 9360 - protein, 112 aa, Artificial Sequence
  Description of Artificial Sequence: Synthetic polypeptide
ELVMTQSPLSLPVTPGEPASISCRSSQSLLYSNGYHYLDWYLQKPGQSPQLLIYLGSIRASGVPDRFSGSGSGTDFTLKISRVEAEDVGVYYCMQPLQTPPTFGPGTKLEIK

SEQ ID NO: 9361 - DNA, 255 bp, Artificial Sequence
  Description of Artificial Sequence: Synthetic polynucleotide
gagctcgtgatgacccagactccactctccctgcccgtcatccctggagagccggcctccatctcctgcaggtctagtcagagcctcctgtatagtaatggatacaactatttggattggtacctgcagaagccagggcagtctccacagctcctgatctatttgggttctaagcgggcctccggggtccctgacaggttcagtggcagtggatcaggcacagattttacactgaaaatcagcagagtggaggct

SEQ ID NO: 9362 - protein, 112 aa, Artificial Sequence
  Description of Artificial Sequence: Synthetic polypeptide
ELVMTQTPLSLPVIPGEPASISCRSSQSLLYSNGYNYLDWYLQKPGQSPQLLIYLGSKRASGVPDRFSGSGSGTDFTLKISRVEAEDVGVYYCMQGTHWPRTFGQGTKVEIK

SEQ ID NO: 9363 - DNA, 255 bp, Artificial Sequence
  Description of Artificial Sequence: Synthetic polynucleotide
gagctcacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcacaatcagcagactggagcctgaagattttgca

SEQ ID NO: 9364 - protein, 108 aa, Artificial Sequence
  Description of Artificial Sequence: Synthetic polypeptide
ELTLTQSPGTLSLSPGERATLSCRASQSVSSSYLAWYQQKPGQAPRLLIYGASSRATGIPDRFSGSGSGTDFTLTISRLEPEDFAVYYCQQYGRSLFTFGPGTKVDIK

SEQ ID NO: 9365 - DNA, 255 bp, Artificial Sequence
  Description of Artificial Sequence: Synthetic polynucleotide
gagctcgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgca

SEQ ID NO: 9366 - protein, 108 aa, Artificial Sequence
  Description of Artificial Sequence: Synthetic polypeptide
ELVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKLEIK

SEQ ID NO: 9367 - DNA, 255 bp, Artificial Sequence
  Description of Artificial Sequence: Synthetic polynucleotide
gagctcgtgatgacccagtctccactctccctgcccgtcacccctggagagccggcctccatctcctgcaggtctagtcagagcctcctgtatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9368 - protein, 112 aa, Artificial Sequence
  Description of Artificial Sequence: Synthetic polypeptide
ELVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPFTFGPGTKVEIK

SEQ ID NO: 9369 - DNA, 255 bp, Artificial Sequence
  Description of Artificial Sequence: Synthetic polynucleotide
gagctccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaact

SEQ ID NO: 9370 - protein, 107 aa, Artificial Sequence
  Description of Artificial Sequence: Synthetic polypeptide
ELQMTQSPSSVSASVGDRVTITCRASQGISSWLAWYQQKPGKAPKLLIYAASSLQSGVPSRFSGSGSGTDFTLTISSLQPEDFATYYCQQANSFPPTFGQGTKVEIK

SEQ ID NO: 9371 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgtatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9372 - protein, 112 aa, Artificial Sequence
  Description of Artificial Sequence: Synthetic polypeptide
ELVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPLTFGGGTKVEIK

SEQ ID NO: 9373 - DNA, 255 bp, Artificial Sequence; identical to SEQ ID NO: 9365
  Description of Artificial Sequence: Synthetic polynucleotide

SEQ ID NO: 9374 - protein, 108 aa, Artificial Sequence; identical to SEQ ID NO: 9366
  Description of Artificial Sequence: Synthetic polypeptide

SEQ ID NO: 9375 - DNA, 255 bp, Artificial Sequence
  Description of Artificial Sequence: Synthetic polynucleotide
gagctcgtgctgactcagtctccactctccctgcccgtctcccctggagagccggcctccatctcctgcaggtctagtcagagcctcctgtatagtaatggatacaactatgtggattggtacttgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9376 - protein, 112 aa, Artificial Sequence
  Description of Artificial Sequence: Synthetic polypeptide
ELVLTQSPLSLPVSPGEPASISCRSSQSLLYSNGYNYVDWYLQKPGQSPQLLIYLGSNRASGVPDRFSGSGSGTDFTLKISRVEAEDVGVYYCMQGTHWPLTFGGGTKVDIK

SEQ ID NO: 9377 - DNA, 255 bp, Artificial Sequence
  Description of Artificial Sequence: Synthetic polynucleotide
gagctcgtgatgactcagactccactctccctgcccgtctcccctggagagccggcctccatctcctgcaggtctagtcagagcctcctgtatagtaatggatacaactatgtggattggtacttgcagaagccagggcagtctccacagctcctgatctatttgggttctaatcgggcctccggggtccctgacaggttcagtggcagtggatcaggcacagattttacactgaaaatcagcaaagtggaggct

SEQ ID NO: 9378 - protein, 112 aa, Artificial Sequence
  Description of Artificial Sequence: Synthetic polypeptide
ELVMTQTPLSLPVSPGEPASISCRSSQSLLYSNGYNYVDWYLQKPGQSPQLLIYLGSNRASGVPDRFSGSGSGTDFTLKISKVEAEDVGVYYCMQALQTPCSFGQGTKLEIK

SEQ ID NO: 9379 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagcgcctcctgtttagtaatggataccactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9380 - protein, 112 aa, Artificial Sequence
  Description of Artificial Sequence: Synthetic polypeptide
ELVMTQSPLSLPVTPGEPASISCRSSQRLLFSNGYHYLDWYLQKPGQSPQLLIYLGSNRASGVPDRFSGSGSGTDFTLKISRVEAEDVGVYYCMQALQTPPTFGQGTKLEIK

SEQ ID NO: 9381 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgtatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9382 - protein, 112 aa, Artificial Sequence
  Description of Artificial Sequence: Synthetic polypeptide
ELVLTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPPTFGQGTKLEIK

SEQ ID NO: 9383 - DNA, 255 bp, Artificial Sequence
  Description of Artificial Sequence: Synthetic polynucleotide
gagctccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatccagtttgcaaagtggggtcccatcaaggttcagtggcagtggatctgggacagatttcactctcaccatcagcagtctgcaacctgaagattttgcaact

SEQ ID NO: 9384 - protein, 107 aa, Artificial Sequence
  Description of Artificial Sequence: Synthetic polypeptide
ELQMTQSPSSLSASVGDRVTITCRASQSISSYLNWYQQKPGKAPKLLIYDASSLQSGVPSRFSGSGSGTDFTLTISSLQPEDFATYYCQQSYRTPPTFGQGTKVDIK

SEQ ID NO: 9385 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgtatagtaatggataccactatttggattggtacctgcagaagccagggcagtctccacagctcctgatctttttgggttctaatcgggcctccggggtccctgacaggttcagtgccagtagatcaggcacagattttacactgaaaatcagcagagtggaggct

SEQ ID NO: 9386 - protein, 112 aa, Artificial Sequence
  Description of Artificial Sequence: Synthetic polypeptide
ELVLTQSPLSLPVTPGEPASISCRSSQSLLYSNGYHYLDWYLQKPGQSPQLLIFLGSNRASGVPDRFSASRSGTDFTLKISRVEAEDVGVYYCMQALQTPFTFGPGTKVEIK

SEQ ID NO: 9387 - DNA, 255 bp, Artificial Sequence
  Description of Artificial Sequence: Synthetic polynucleotide
gagctcgtgatgactcagactccactctccctgcccgtctcccctggagagccggcctccatctcctgcaggtctagtcagagcctcctgtatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9388 - protein, 112 aa, Artificial Sequence
  Description of Artificial Sequence: Synthetic polypeptide
ELVMTQTPLSLPVSPGEPASISCRSSQSLLYSNGYNYLDWYLQKPGQSPQLLIYLGSNRASGVPDRFSGSGSGTDFTLKISRVEAEDVGVYYCMQALQTPITFGQGTRLEIK

SEQ ID NO: 9389 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgtatagtaatggatacaactatttggattggtacctgcagaagccagggcagtctccacagctcctgatctatttgggttctaatcgggcctccggggtccctgacaggttcagtggcagtggatcaggcacagattttacactgcaaatcagcagggtggaggct

SEQ ID NO: 9390 - protein, 112 aa, Artificial Sequence
  Description of Artificial Sequence: Synthetic polypeptide
ELVMTQSPLSLPVTPGEPASISCRSSQSLLYSNGYNYLDWYLQKPGQSPQLLIYLGSNRASGVPDRFSGSGSGTDFTLQISRVEAEDVGVYYCMQGTHWPFTFGPGTKVEIK

SEQ ID NO: 9391 - DNA, 255 bp, Artificial Sequence; identical to SEQ ID NO: 9367
  Description of Artificial Sequence: Synthetic polynucleotide

SEQ ID NO: 9392 - protein, 112 aa, Artificial Sequence
  Description of Artificial Sequence: Synthetic polypeptide
ELVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPWTFGQGTKVDIK

SEQ ID NO: 9393 - DNA, 255 bp, Artificial Sequence
  Description of Artificial Sequence: Synthetic polynucleotide
gagctcgtgatgactcagtctccactctccctgcccgtctcccctggagagccggcctccatctcctgcaggtctagtcagagcctcctgtatagtaatggatacaactatgtggattggtacttgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9394 - protein, 112 aa, Artificial Sequence
  Description of Artificial Sequence: Synthetic polypeptide
ELVMTQSPLSLPVSPGEPASISCRSSQSLLYSNGYNYVDWYLQKPGQSPQLLIYLGSNRASGVPDRFSGSGSGTDFTLKISRVEAEDVGVYYCMQSIQLPWTFGQGTKVDIK

SEQ ID NO: 9395 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgtatagtaatggatacaactatttggattggtacctgcagaagccagggcaatctccacatctcctgatctatttgggttcttatcgggcctccggggtccctgacaggttcagtggcagtgcatcaggcacagatttcacactgaaaatcagcagggtggaggct

SEQ ID NO: 9396 - protein, 112 aa, Artificial Sequence
  Description of Artificial Sequence: Synthetic polypeptide
ELVLTQSPLSLPVTPGEPASISCRSSQSLLYSNGYNYLDWYLQKPGQSPHLLIYLGSYRASGVPDRFSGSASGTDFTLKISRVEAEDVGVYYCMQGTHWPLTFGGGTKLEIK

SEQ ID NO: 9397 - DNA, 255 bp, Artificial Sequence
  Description of Artificial Sequence: Synthetic polynucleotide
gagctcgtgatgactcagactccactctccctgcccgtcatccctggagagccggcctccatctcctgcaggtctagtcagagcctcctgtttagtaatggatacaactatttggattggtacctgcagaagccagggcagtctccacagctcctgatctatttggtctctaagcgggcctccggggtccctgacaggttcagtggcagtggatcaggcacagattttacactgaaaatcagcagagtggaggct

SEQ ID NO: 9398 - protein, 112 aa, Artificial Sequence
  Description of Artificial Sequence: Synthetic polypeptide
ELVMTQTPLSLPVIPGEPASISCRSSQSLLFSNGYNYLDWYLQKPGQSPQLLIYLVSKRASGVPDRFSGSGSGTDFTLKISRVEAEDVGVYYCMQALQTPLTFGGGTKLEIK

SEQ ID NO: 9399 - DNA, 255 bp, Artificial Sequence
  Description of Artificial Sequence: Synthetic polynucleotide
gagctccagatgacccagtctccatcttccgtgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcagct

SEQ ID NO: 9400 - protein, 107 aa, Artificial Sequence
  Description of Artificial Sequence: Synthetic polypeptide
ELQMTQSPSSVSASVGDRVTITCRASQSISSYLNWYQQKPGKAPKLLIYAASSLQSGVPSRFSGSGSGTDFTLTISSLQPEDFAAYYCQQSYSTPPTFGQGTKVEIK

SEQ ID NO: 9401 - DNA, 255 bp, Artificial Sequence
  Description of Artificial Sequence: Synthetic polynucleotide
gagctccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccagtttgcaaagtggggtcccatcaaggttcagtggcagtggatctgggacagatttcactctcaccatcagcagtctgcaacctgaagattttgcaact

SEQ ID NO: 9402 - protein, 107 aa, Artificial Sequence
  Description of Artificial Sequence: Synthetic polypeptide
ELQMTQSPSSLSASVGDRVTITCRASQGISNYLAWYQQKPGKVPKLLIYAASSLQSGVPSRFSGSGSGTDFTLTISSLQPEDFATYYCQQSYSTPFTFGPGTKVEIK

SEQ ID NO: 9403 - DNA, 255 bp, Artificial Sequence
  Description of Artificial Sequence: Synthetic polynucleotide
gagctcgtgatgacccagactccactctccctgcccgtcacccctggagagccggcctccatctcctgcaggtctagtcagagcctcctgtatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9404 - protein, 112 aa, Artificial Sequence
  Description of Artificial Sequence: Synthetic polypeptide
ELVMTQTPLSLPVTPGEPASISCRSSQSLLYSNGYNYLDWYLQKPGQSPQLLIYLGSNRASGVPDRFSGSGSGTDFTLKISRVEAEDVGVYYCMQGTHWPFTFGPGTKVEIK

SEQ ID NO: 9405 - DNA, 255 bp, Artificial Sequence
  Description of Artificial Sequence: Synthetic polynucleotide
gagctcgtgatgactcagactccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9406 - protein, 112 aa, Artificial Sequence
  Description of Artificial Sequence: Synthetic polypeptide
ELVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK

SEQ ID NO: 9407 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgtttagtaatggatactactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9408 - protein, 112 aa, Artificial Sequence
  Description of Artificial Sequence: Synthetic polypeptide
ELVLTQSPLSLPVTPGEPASISCRSSQSLLFSNGYYYLDWYLQKPGQSPQLLIYLGSNRASGVPDRFSGSGSGTDFTLKISRVEAEDVGVYYCMQALQTPPTFGQGTKVEIK

SEQ ID NO: 9409 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgtatagtaatggatacaactatttggattggtacctgcagaagccagggcagtctccacagctcctgatctatttgggttctaatcgggcctccggggtccctgacaggttcagtggcagtagatcaggcacagattttacactgaaaatcagcagagtggaggct

SEQ ID NO: 9410 - protein, 112 aa, Artificial Sequence
  Description of Artificial Sequence: Synthetic polypeptide
ELVMTQSPLSLPVTPGEPASISCRSSQSLLYSNGYNYLDWYLQKPGQSPQLLIYLGSNRASGVPDRFSGSRSGTDFTLKISRVEAEDVGVYYCMQALQTPFTFGPGTKVDIK

SEQ ID NO: 9411 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagtctgcaacctgaagattttgcaact

SEQ ID NO: 9412 - protein, 107 aa, Artificial Sequence
  Description of Artificial Sequence: Synthetic polypeptide
ELVMTQSPSSLSASVGDRVTITCRASQGISNYLAWYQQKPGKVPKLLIYAASTLQSGVPSRFSGSGSGTDFTLTISSLQPEDFATYYCQQSYSTPPTFGQGTKVEIK

SEQ ID NO: 9413 - DNA, 255 bp, Artificial Sequence; identical to SEQ ID NO: 9403
  Description of Artificial Sequence: Synthetic polynucleotide

SEQ ID NO: 9414 - protein, 111 aa, Artificial Sequence
  Description of Artificial Sequence: Synthetic polypeptide
ELVMTQTPLSLPVTPGEPASISCRSSQSLLYSNGYNYLDWYLQKPGQSPQLLIYLGSNRASGVPDRFSGSGSGTDFTLKISRVEAEDVGVYYCMQALQSLTFGGGTKLEIK

SEQ ID NO: 9415 - DNA, 255 bp, Artificial Sequence
  Description of Artificial Sequence: Synthetic polynucleotide
gagctcgtgatgactcagactccactctccctgcccgtcacccctggagagccggcctccatctcctgcaggtctagtcagagcctcctgtatagtaatggatacaactatttggattggtacctgcagaagccagggcagtctccacagctcctgatctatttgggttctaagcgggcctccggggtccctgacaggttcagtggcagtggatcaggcacagattttacactgaaaatcagcagagtggaggct

SEQ ID NO: 9416 - protein, 112 aa, Artificial Sequence
  Description of Artificial Sequence: Synthetic polypeptide
ELVMTQTPLSLPVTPGEPASISCRSSQSLLYSNGYNYLDWYLQKPGQSPQLLIYLGSKRASGVPDRFSGSGSGTDFTLKISRVEAEDVGVYYCMQALQTPLTFGGGTKVDIK

SEQ ID NO: 9417 - DNA, 255 bp, Artificial Sequence
  Description of Artificial Sequence: Synthetic polynucleotide
gagctcgtgatgacccagtctccactctctctgtccgtcacccctggagagccggcctccatctcctgcaggtctagtcggagcctcctgcatagtaatggatacaactatttggattggtacctgcagaagccagggcagtctccacagctcctgatctatttgggttctaatcgggcctccggggtccctgacaggttcagtggcagtggatcaggcatagattttacactgaaaatcagcagagtggaggct

SEQ ID NO: 9418 - protein, 111 aa, Artificial Sequence
  Description of Artificial Sequence: Synthetic polypeptide
ELVMTQSPLSLSVTPGEPASISCRSSRSLLHSNGYNYLDWYLQKPGQSPQLLIYLGSNRASGVPDRFSGSGSGIDFTLKISRVEAEDVGVYYCMQALQTPHFGGGTKVEIK

SEQ ID NO: 9419 - DNA, 255 bp, Artificial Sequence
  Description of Artificial Sequence: Synthetic polynucleotide
gagctcgtgatgactcagtctccactctctctgtccgtcacccctggacagccggcctccatctcctgcaagtctagtcagagcctcctgtatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagggtggaggct

SEQ ID NO: 9420 - protein, 112 aa, Artificial Sequence
  Description of Artificial Sequence: Synthetic polypeptide
ELVMTQSPLSLSVTPGQPASISCKSSQSLLYSNGYNYLDWYLQKPGQSPQLLIYLGSNRASGVPDRFSGSGSGTDFTLKISRVEAEDVGVYYCMQALQTPITFGQGTRLEIK

SEQ ID NO: 9421 - DNA, 255 bp, Artificial Sequence
  Description of Artificial Sequence: Synthetic polynucleotide
gagctcgccctgactcagcctccctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaagcggccctcaggggtttctaatcgcttctctggctccaagtctggcaacacggcctccctgaccatctctgggctccaggctgaggacgag

SEQ ID NO: 9422 - protein, 110 aa, Artificial Sequence
  Description of Artificial Sequence: Synthetic polypeptide
ELALTQPPSVSGSPGQSITISCTGTSSDVGGYNYVSWYQQHPGKAPKLMIYEVSKRPSGVSNRFSGSKSGNTASLTISGLQAEDEADYYCSSYTSSSTLVFGGGTKLTVL

SEQ ID NO: 9423 - DNA, 255 bp, Artificial Sequence
  Description of Artificial Sequence: Synthetic polynucleotide
gagctcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcag

SEQ ID NO: 9424 - protein, 113 aa, Artificial Sequence
  Description of Artificial Sequence: Synthetic polypeptide
ELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 9425 - DNA, 255 bp, Artificial Sequence; identical to SEQ ID NO: 9423
  Description of Artificial Sequence: Synthetic polynucleotide

SEQ ID NO: 9426 - protein, 113 aa, Artificial Sequence; identical to SEQ ID NO: 9424
  Description of Artificial Sequence: Synthetic polypeptide

SEQ ID NO: 9427 - DNA, 255 bp, Artificial Sequence
  Description of Artificial Sequence: Synthetic polynucleotide
gagctcacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccgccagggccactggcatcccagacaggttcagtggcagtgggtctgggacagacttcactctcaccatcagcagactggagcctgaagattttgca

SEQ ID NO: 9428 - protein, 107 aa, Artificial Sequence
  Description of Artificial Sequence: Synthetic polypeptide
ELTLTQSPGTLSLSPGERATLSCRASQSVSSSYLAWYQQKPGQAPRLLIYGASARATGIPDRFSGSGSGTDFTLTISRLEPEDFAVYYCQQYGSSLTFGGGTKVDIK

SEQ ID NO: 9429 - DNA, 255 bp, Artificial Sequence
  Description of Artificial Sequence: Synthetic polynucleotide
gagctcgtgctgactcagccaccctcagcgtctgggacccccgggcagaggatcaccatctcttgttctggcagcagctccaacatcggaagtaattatgtatactggtatcagcatctcccaggaacggcccccaaactcctcatctataggaataatcagcggccctcaggggtccctgaccgattctctggctccaagtctggcacctcagcctccctggccatcagtgggctccggtccgaggatgaggct

SEQ ID NO: 9430 - protein, 110 aa, Artificial Sequence
  Description of Artificial Sequence: Synthetic polypeptide
ELVLTQPPSASGTPGQRITISCSGSSSNIGSNYVYWYQHLPGTAPKLLIYRNNQRPSGVPDRFSGSKSGTSASLAISGLRSEDEADYYCAAWDDSLSGVVFGGGTKLTVL

SEQ ID NO: 9431 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggcagtggatctgggacagattttactttcaccatcagcagtctgcaacctgaagattttgcaact

SEQ ID NO: 9432 - protein, 107 aa, Artificial Sequence
  Description of Artificial Sequence: Synthetic polypeptide
ELVMTQSPSSLSASVGDRVTITCQASQDISNYLNWYQQKPGKAPKLLIYDASNLETGVPSRFSGSGSGTDFTFTISSLQPEDFATYYCQQSYSIPPTFGQGTKVEIK

SEQ ID NO: 9433 - DNA, 255 bp, Artificial Sequence
  Description of Artificial Sequence: Synthetic polynucleotide
gagctcgtgctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggct

SEQ ID NO: 9434 - protein, 110 aa, Artificial Sequence
  Description of Artificial Sequence: Synthetic polypeptide
ELVLTQPPSVSKGLRQTATLTCTGNSNNVGNQGAAWLQQHQGHPPKLLSYRNNNRPSGISERLSASRSGNTASLTITGLQPEDEADYYCSAWDSSLSAWVFGGGTKLTVL

SEQ ID NO: 9435 - DNA, 255 bp, Artificial Sequence
  Description of Artificial Sequence: Synthetic polynucleotide
gagctcgtgctgactcagccatcctcggtgtccaaggacttgagacagaccgccacactcacctgcactgggaacagcaacaatgttggcaaccaaggagcagcttggctgcagcaacaccagggccaccctcccaaactcctatcctacaggaataacaaccggccctcagggatctcagagagattatctgcatccaggtcaggaaacacagcctccctgaccattactggactccagcctgaggacgaggct

SEQ ID NO: 9436 - protein, 110 aa, Artificial Sequence
  Description of Artificial Sequence: Synthetic polypeptide
ELVLTQPSSVSKDLRQTATLTCTGNSNNVGNQGAAWLQQHQGHPPKLLSYRNNNRPSGISERLSASRSGNTASLTITGLQPEDEADYYCSAWDSSLSAWVFGGGTKLTVL

SEQ ID NO: 9437 - DNA, 255 bp, Artificial Sequence; identical to SEQ ID NO: 9423
  Description of Artificial Sequence: Synthetic polynucleotide

SEQ ID NO: 9438 - protein, 113 aa, Artificial Sequence
  Description of Artificial Sequence: Synthetic polypeptide
ELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKLEIK

SEQ ID NO: 9439 - DNA, 255 bp, Artificial Sequence; identical to SEQ ID NO: 9423
  Description of Artificial Sequence: Synthetic polynucleotide

SEQ ID NO: 9440 - protein, 113 aa, Artificial Sequence; identical to SEQ ID NO: 9438
  Description of Artificial Sequence: Synthetic polypeptide

SEQ ID NO: 9441 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9442 - protein, 112 aa, Artificial Sequence
  Description of Artificial Sequence: Synthetic polypeptide
ELVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIK

SEQ ID NO: 9443 - DNA, 255 bp, Artificial Sequence
  Description of Artificial Sequence: Synthetic polynucleotide
gagctcacactcacgcagtctccaggcaccctgtctttgtctccaggggaaagagccaccctctcctgcagggccagtcagagtgttagcagcggctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgca

SEQ ID NO: 9444 - protein, 108 aa, Artificial Sequence
  Description of Artificial Sequence: Synthetic polypeptide
ELTLTQSPGTLSLSPGERATLSCRASQSVSSGYLAWYQQKPGQAPRLLIYGASSRATGIPDRFSGSGSGTDFTLTISRLEPEDFAVYYCQQYGSSPFTFGPGTKVEIK

SEQ ID NO: 9445 - DNA, 255 bp, Artificial Sequence; identical to SEQ ID NO: 9423
  Description of Artificial Sequence: Synthetic polynucleotide

SEQ ID NO: 9446 - protein, 113 aa, Artificial Sequence
  Description of Artificial Sequence: Synthetic polypeptide
ELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 9447 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcatcgtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9448 - protein, 112 aa, Artificial Sequence
  Description of Artificial Sequence: Synthetic polypeptide
ELVLTQSPLSLPVTPGEPASISCRSSQSLLHRNGYNYLDWYLQKPGQSPQLLIYLGSNRASGVPDRFSGSGSGTDFTLKISRVEAEDVGVYYCMQALQTPITFGQGTRLEIK

SEQ ID NO: 9449 - DNA, 255 bp, Artificial Sequence; identical to SEQ ID NO: 9423
  Description of Artificial Sequence: Synthetic polynucleotide

SEQ ID NO: 9450 - protein, 113 aa, Artificial Sequence; identical to SEQ ID NO: 9446
  Description of Artificial Sequence: Synthetic polypeptide

SEQ ID NO: 9451 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaact

SEQ ID NO: 9452 - protein, 107 aa, Artificial Sequence
  Description of Artificial Sequence: Synthetic polypeptide
ELVMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKLEIK

SEQ ID NO: 9453 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctacatccagtttgcaaagtggggtcccatcaaggttcagtggcagtggatctgggacagatttcactctcaccatcagcagtctgcaacctgaagattttgcaact

SEQ ID NO: 9454 - protein, 107 aa, Artificial Sequence
  Description of Artificial Sequence: Synthetic polypeptide
ELVMTQSPSSLSASVGDRVTITCRASQSISSYLNWYQQKPGKAPKLLIYATSSLQSGVPSRFSGSGSGTDFTLTISSLQPEDFATYYCQQSYSTPPTFGQGTKVEIK

SEQ ID NO: 9455 - DNA, 255 bp, Artificial Sequence
  Description of Artificial Sequence: Synthetic polynucleotide
gagctcgccctgactcagcctgcctccgcgtctgggtctcctggacagtcgatcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgag

SEQ ID NO: 9456 - protein, 110 aa, Artificial Sequence
  Description of Artificial Sequence: Synthetic polypeptide
ELALTQPASASGSPGQSITISCTGTSSDVGGYNYVSWYQQHPGKAPKLMIYEVSKRPSGVPDRFSGSKSGNTASLTVSGLQAEDEADYYCSSYAGSNNVVFGGGTKLTVL

SEQ ID NO: 9457 - DNA, 255 bp, Artificial Sequence
  Description of Artificial Sequence: Synthetic polynucleotide
gagctcacactcacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggtatcccagccaggttcagtggcagtgggtctgggacagacttcactctcaccatcagcagactggagcctgaagattttgcc

SEQ ID NO: 9458 - protein, 108 aa, Artificial Sequence
  Description of Artificial Sequence: Synthetic polypeptide
ELTLTQSPGTLSLSPGERATLSCRASQSVSSSYLAWYQQKPGQAPRLLIYGASSRATGIPARFSGSGSGTDFTLTISRLEPEDFAVYYCQQYGSSPLTFGGGTKLEIK

SEQ ID NO: 9459 - DNA, 255 bp, Artificial Sequence; identical to SEQ ID NO: 9423
  Description of Artificial Sequence: Synthetic polynucleotide

SEQ ID NO: 9460 - protein, 113 aa, Artificial Sequence
  Description of Artificial Sequence: Synthetic polypeptide
ELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVDIK

SEQ ID NO: 9461 - DNA, 255 bp, Artificial Sequence
  Description of Artificial Sequence: Synthetic polynucleotide
gagctcgtgatgacacagtctccaggcaccctgtctctgtctccaggggaaagagccaccctctcctgcagggccagtcagagtgttagcagcagctacttagcctggtaccagcagaaacctggccaggctcccaggctcctcatctatggtgcatccaccagggccactggcatcccagacaggttcagtggcagtgggtctgggacagacttcactctcaccatcagcagactggagcctgaagattttgca

SEQ ID NO: 9462 - protein, 108 aa, Artificial Sequence
  Description of Artificial Sequence: Synthetic polypeptide
ELVMTQSPGTLSLSPGERATLSCRASQSVSSSYLAWYQQKPGQAPRLLIYGASTRATGIPDRFSGSGSGTDFTLTISRLEPEDFAVYYCQQYGTSPLTFGGGTKVDIK

SEQ ID NO: 9463 - DNA, 255 bp, Artificial Sequence
  Description of Artificial Sequence: Synthetic polynucleotide
gagctcgtgatgacccagtctccactctccctgcccgtcatccctggagagccggcctccatctcctgcaggtctagtcagagcctcctgtatagtaatggatacaactatttggattggtacctgcagaagccagggcagtctccacagctcctgatctatttgggttctaagcgggcctccggggtccctgacaggttcagtggcagtggatcaggcacagattttacactgaaaatcagcagagtggaggct

SEQ ID NO: 9464 - protein, 112 aa, Artificial Sequence
  Description of Artificial Sequence: Synthetic polypeptide
ELVMTQSPLSLPVIPGEPASISCRSSQSLLYSNGYNYLDWYLQKPGQSPQLLIYLGSKRASGVPDRFSGSGSGTDFTLKISRVEAEDVGVYYCMQVLQTPPTFGQGTKLDIK

SEQ ID NO: 9465 - DNA, 255 bp, Artificial Sequence; identical to SEQ ID NO: 9423
  Description of Artificial Sequence: Synthetic polynucleotide

SEQ ID NO: 9466 - protein, 113 aa, Artificial Sequence
  Description of Artificial Sequence: Synthetic polypeptide
ELVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIK

SEQ ID NO: 9467 - DNA, 255 bp, Artificial Sequence
  Description of Artificial Sequence: Synthetic polynucleotide
gagctccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaact

SEQ ID NO: 9468 - protein, 107 aa, Artificial Sequence
  Description of Artificial Sequence: Synthetic polypeptide
ELQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 9469 - DNA, 255 bp, Artificial Sequence
  Description of Artificial Sequence: Synthetic polynucleotide
gagctccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctacatccagtttgcaaagtggggtcccatcacggttcagtggcagtggatctgggacagatttcactctcaccatcagcagtctgcaacctgaagattttgcaact

SEQ ID NO: 9470 - protein, 107 aa, Artificial Sequence
  Description of Artificial Sequence: Synthetic polypeptide
ELQMTQSPSSLSASVGDRVTITCRASQSISSYLNWYQQKPGKAPKLLIYATSSLQSGVPSRFSGSGSGTDFTLTISSLQPEDFATYYCQQSYSIPFTFGPGTKVEIK

SEQ ID NO: 9471 - DNA, 255 bp, Artificial Sequence
  Description of Artificial Sequence: Synthetic polynucleotide
gagctccagatgacccagtctccatcttccgtgtctgcatctgtaggagacagagtcaccatcacttgccaggcgagtcaggacattagcaactatttaaattggtatcagcagaaaccagggaaagcccctaagctcctgatctatgctgcatccagtttgcaaagtggggtcccatcacggttcagtggcagtggatctgggacagatttcactctcaccatcagcagtctgcaacctgaagattttgcaact

SEQ ID NO: 9472 - protein, 107 aa, Artificial Sequence
  Description of Artificial Sequence: Synthetic polypeptide
ELQMTQSPSSVSASVGDRVTITCQASQDISNYLNWYQQKPGKAPKLLIYAASSLQSGVPSRFSGSGSGTDFTLTISSLQPEDFATYYCQQSYSTPLTFGGGTKVDIK

SEQ ID NO: 9473 - DNA, 255 bp, Artificial Sequence
  Description of Artificial Sequence: Synthetic polynucleotide
gagctccagatgacccagtctccatcctccctgtctgcatctgtaggagacagagtcaccatcacttgtcgggcgagtcagggcattagcaattatttggcatggtatcagcagaagccagggaaagttcctaatctcctgatctatggtgcatccactttgcaattaggggtcccatctcggttcagtggcagtggctctgggacagatttcactctcaccatcagcagcctgcagcctgaagatgttgcaact

SEQ ID NO: 9474 - protein, 107 aa, Artificial Sequence
  Description of Artificial Sequence: Synthetic polypeptide
ELQMTQSPSSLSASVGDRVTITCRASQGISNYLAWYQQKPGKVPNLLIYGASTLQLGVPSRFSGSGSGTDFTLTISSLQPEDVATYYCQKYYSAPFTFGPGTKVDIK

SEQ ID NO: 9475 - DNA, 255 bp, Artificial Sequence; identical to SEQ ID NO: 9467
  Description of Artificial Sequence: Synthetic polynucleotide

SEQ ID NO: 9476 - protein, 107 aa, Artificial Sequence
  Description of Artificial Sequence: Synthetic polypeptide
ELQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKLEIK

SEQ ID NO: 9477 - DNA, 255 bp, Artificial Sequence
  Description of Artificial Sequence: Synthetic polynucleotide
gagctcgtgctgactcagctaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggct

SEQ ID NO: 9478 - protein, 110 aa, Artificial Sequence
  Description of Artificial Sequence: Synthetic polypeptide
ELVLTQLPSVSKGLRQTATLTCTGNSNNVGNQGAAWLQQHQGHPPKLLSYRNNNRPSGISERLSASRSGNTASLTITGLQPEDEADYYCSAWDSSLSAVVFGGGTKLTVL

SEQ ID NO: 9479 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccaggcgagtcaggacattagcaactatttaaattggtatcagcagaaaccagggaaggcccctaagctcctgatctatgctgcatccagtttgcaaagtggggtcccatcaaggttcagcggcagtggatctgggacagaattcactctcacaatcagcagcctgcagcctgaagattttgcaact

SEQ ID NO: 9480 - protein, 107 aa, Artificial Sequence
  Description of Artificial Sequence: Synthetic polypeptide
ELVMTQSPSSLSASVGDRVTITCQASQDISNYLNWYQQKPGKAPKLLIYAASSLQSGVPSRFSGSGSGTEFTLTISSLQPEDFATYYCQQSYSTPPTFGQGTKVDIK

SEQ ID NO: 9481 - DNA, 255 bp, Artificial Sequence; identical to SEQ ID NO: 9451
  Description of Artificial Sequence: Synthetic polynucleotide

SEQ ID NO: 9482 - protein, 107 aa, Artificial Sequence
  Description of Artificial Sequence: Synthetic polypeptide
ELVMTQSPSSLSASVGDRVTITCRASQSISSYLNWYQQKPGKAPKLLIYAASSLQSGVPSRFSGSGSGTDFTLTISSLQPEDFATYYCQQSYSVPPTFGQGTKVDIK

SEQ ID NO: 9483 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgcacagaaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9484 - protein, 112 aa, Artificial Sequence
  Description of Artificial Sequence: Synthetic polypeptide
ELVMTQSPLSLPVTPGEPASISCRSSQSLLHRNGYNYLDWYLQKPGQSPQLLIYLGSNRASGVPDRFSGSGSGTDFTLKISRVEAEDVGVYYCMQALQTPFTFGPGTKVDIK

SEQ ID NO: 9485 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcatagtaatggatacaactatttggattggtacctgcagaagccagggcagtctccacaactcctgatctatttgggttctaatcgggcctccggggtccctgacaggttcagtggcagtggatcaggcacagattttacactaaaaatcagcagagtggaggct

SEQ ID NO: 9486 - protein, 112 aa, Artificial Sequence
  Description of Artificial Sequence: Synthetic polypeptide
ELVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGPGTKVEIK

SEQ ID NO: 9487 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgcatagtaatggatacaactatgtggattggtacctgcagaagccagggcagtctccacagctcctgatctatttgggttctaatcgggcctccggggtccctgacaggttcagtggcagtggatcaggcgcagattttacactgaaaatcagcagagtggaggct

SEQ ID NO: 9488 - protein, 112 aa, Artificial Sequence
  Description of Artificial Sequence: Synthetic polypeptide
ELVMTQSPLSLPVTPGEPASISCRSSQSLLHSNGYNYVDWYLQKPGQSPQLLIYLGSNRASGVPDRFSGSGSGADFTLKISRVEAEDVGVYYCMQALQTPLTFGGGTKVEIK

SEQ ID NO: 9489 - DNA, 255 bp, Artificial Sequence
  Description of Artificial Sequence: Synthetic polynucleotide
gagctcgtgttgacgcagtctccaggcaccctgtctttgtctccaggggaaagagccaccctctcctgcaggtctagtcagagcctcctgcatagaaatggatacaattatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9490 - protein, 112 aa, Artificial Sequence
  Description of Artificial Sequence: Synthetic polypeptide
ELVLTQSPGTLSLSPGERATLSCRSSQSLLHRNGYNYLDWYLQKPGQSPQLLIYLGSNRASGVPDRFSGSGSGTDFTLKISRVEAEDVGVYYCMQALQTPRTFGQGTKVEIK

SEQ ID NO: 9491 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccaggcgaggcaggacattagcgactatttaaattggtttcagcagaaaccagggagagcccctaagctcctgatctttgctgcatccagtttgcaaggtggggtcccatctcggttcagtggcagtggatctgggacagatttcactctcaccatcagcagtctgcaacctgaagattttgcaact

SEQ ID NO: 9492 - protein, 107 aa, Artificial Sequence
  Description of Artificial Sequence: Synthetic polypeptide
ELVMTQSPSSLSASVGDRVTITCQARQDISDYLNWFQQKPGRAPKLLIFAASSLQGGVPSRFSGSGSGTDFTLTISSLQPEDFATYYCQQTYSMPFTFGPGTKVDIK

SEQ ID NO: 9493 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccggacaagtcagagcattaacagctatttaaattggtttcaacagaaaccagggaaagcccctaagctcctgatctatgctgcatccagtttgcaaagtggggtcccatcaaggttcagtggcagtggatctgggacagatttcactctcaccatcagcagtctccaacctgaagattttgcaact

SEQ ID NO: 9494 - protein, 107 aa, Artificial Sequence
  Description of Artificial Sequence: Synthetic polypeptide
ELVMTQSPSSLSASVGDRVTITCRTSQSINSYLNWFQQKPGKAPKLLIYAASSLQSGVPSRFSGSGSGTDFTLTISSLQPEDFATYYCQQSYSTPFTFGPGTKVDIK

SEQ ID NO: 9495 - DNA, 255 bp, Artificial Sequence
  Description of Artificial Sequence: Synthetic polynucleotide
gagctcgtgatgacccagtctccactctccctgcccgtcacccctggagagccggcctccatctcctgcaggtctagtcagagcctcctgcatagtactggatacaactatttggattggtacctgcagaagccggggcagtctccacagctcctgatctatttgggttctaatcgggcctccggggtccctgacaggttcagtggcagtggatcaggcacagattttacactgaaaatcagcagagtggaggct

SEQ ID NO: 9496 - protein, 112 aa, Artificial Sequence
  Description of Artificial Sequence: Synthetic polypeptide
ELVMTQSPLSLPVTPGEPASISCRSSQSLLHSTGYNYLDWYLQKPGQSPQLLIYLGSNRASGVPDRFSGSGSGTDFTLKISRVEAGDVGFYYCMQALQTPRTFGQGTKLEIK

SEQ ID NO: 9497 - DNA, 255 bp, Artificial Sequence
  Description of Artificial Sequence: Synthetic polynucleotide
gagctcgtgatgactcagactccactctccctgcccgtcacccctggagagccggcctccatctcctgcaggtctagtcagagcctcctgcatagaaatggatacaattatttggattggtacttgcataaaccagggcagtctccacagctcctgatctatttgggttctaatcgggcctccggggtccctgacaggttcattggcagtggctcaggcacagattttacactgaaaatcagcaaagtggaggct

SEQ ID NO: 9498 - protein, 112 aa, Artificial Sequence
  Description of Artificial Sequence: Synthetic polypeptide
ELVMTQTPLSLPVTPGEPASISCRSSQSLLHRNGYNYLDWYLHKPGQSPQLLIYLGSNRASGVPDRFIGSGSGTDFTLKISKVEAEDVGIYYCMQALQTPRTFGQGTKVEIK

SEQ ID NO: 9499 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcatcgtaatggataccactatttggattggtacctgcagaagccagggcagtctccacaactcctgatctatttgggttctaatcgggcctccggggtccctgacaggttcattggcagtggctcaggcacagattttacactggaaatcagcagagtggaggct

SEQ ID NO: 9500 - protein, 111 aa, Artificial Sequence
  Description of Artificial Sequence: Synthetic polypeptide
ELVLTQSPLSLPVTPGEPASISCRSSQSLLHRNGYHYLDWYLQKPGQSPQLLIYLGSNRASGVPDRFIGSGSGTDFTLEISRVEAEDVGVYYCMQALQTPSFGQGTKLEIK

SEQ ID NO: 9501 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcatagaaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9502 - protein, 112 aa, Artificial Sequence
  Description of Artificial Sequence: Synthetic polypeptide
ELVLTQSPLSLPVTPGEPASISCRSSQSLLHRNGYNYLDWYLQKPGQSPQLLIYLGSNRASGVPDRFSGSGSGTDFTLKISRVEAEDVGVYYCMQALQTPFTFGPGTKVEIK

SEQ ID NO: 9503 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccggacaagtcagagcattagcagctatttaaattggtatcagcagaaaccagggagagcccctaagctcctgatctttgctgcatccagtttgcaaggtggggtcccatcaaggttcagtggcagtggatctgggacagatttcactctcaccatcagcagtctccaacctgaagattttgcaact

SEQ ID NO: 9504 - protein, 107 aa, Artificial Sequence
  Description of Artificial Sequence: Synthetic polypeptide
ELVMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 9505 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccggacaagtcagagcattaacagctatttaaattggtttcaacagaaaccagggaaagcccctaagctcctgatctttgctgcatccagtttacaaagtggggtcccatcaaggttcagtggcagtggatctgggacagatttcactctcaccatcagcagtctgcaacgtgaagattttgcaact

SEQ ID NO: 9506 - protein, 107 aa, Artificial Sequence
  Description of Artificial Sequence: Synthetic polypeptide
ELVMTQSPSSLSASVGDRVTITCRTSQSINSYLNWFQQKPGKAPKLLIFAASSLQSGVPSRFSGSGSGTDFTLTISSLQREDFATYYCQQSYSTPFTFGPGTKVDIK

SEQ ID NO: 9507 - DNA, 255 bp, Artificial Sequence
  Description of Artificial Sequence: Synthetic polynucleotide
gagctccagatgacccagtctccatcctccctgtctgcatctgtaggagacagagtcaccatcacttgccggacaagtcagagcattagcagctatttaaattggtatcagcagaaaccagggagagcccctaagctcctgatctttgctgcatccagtttgcaaggtggggtcccatcaaggttcagtggcagtggatctgggacagatttcactctcaccatcagcagtctccaacctgaagattttgcaact

SEQ ID NO: 9508 - protein, 107 aa, Artificial Sequence
  Description of Artificial Sequence: Synthetic polypeptide
ELQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKLEIK

SEQ ID NO: 9509 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcatcgtaatggatacaactatttggattggtacctgcagaagccagggcagtctccacagctcctgatctatttgggttctaatcgggcctccggggtccctgacaggttcattggcagtggctcaggcacagattttacactggaaatcagcagagtggaggct

SEQ ID NO: 9510 - protein, 111 aa, Artificial Sequence
  Description of Artificial Sequence: Synthetic polypeptide
ELVLTQSPLSLPVTPGEPASISCRSSQSLLHRNGYNYLDWYLQKPGQSPQLLIYLGSNRASGVPDRFIGSGSGTDFTLEISRVEAEDVGVYYCMQALQTPSFGQGTKLEIK

SEQ ID NO: 9511 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcatcgtaatggataccactatttggattggtacctgcagaagccagggcagtctccacaactcctgatctatttgggttctaatcgggcctccggggtccctgacaggttcagtggcagtggatcaggcacagattttacactgaaaatcagcagagtggaggct

SEQ ID NO: 9512 - protein, 112 aa, Artificial Sequence
  Description of Artificial Sequence: Synthetic polypeptide
ELVLTQSPLSLPVTPGEPASISCRSSQSLLHRNGYHYLDWYLQKPGQSPQLLIYLGSNRASGVPDRFSGSGSGTDFTLKISRVEAEDVGVYYCMQALQTPFTFGPGTKVEIK

SEQ ID NO: 9513 - DNA, 255 bp, Artificial Sequence
  Description of Artificial Sequence: Synthetic polynucleotide
gagctcgtgatgacccagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactaaaaatcagcagagtggaggct

SEQ ID NO: 9514 - protein, 112 aa, Artificial Sequence
  Description of Artificial Sequence: Synthetic polypeptide
ELVMTQSPLSLPVTPGEPASISCRSSQSLLHSNGYNYLDWYLQKPGQSPQLLIYLGSNRASGVPDRFSGSGSGTDFTLKISRVEAEDVGFYYCMQALQTPRTFGQGTKVEIK

SEQ ID NO: 9515 - DNA, 255 bp, Artificial Sequence
  Description of Artificial Sequence: Synthetic polynucleotide
gagctcgtgatgacccagactccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactaaaaatcagcagagtggaggct

SEQ ID NO: 9516 - protein, 112 aa, Artificial Sequence
  Description of Artificial Sequence: Synthetic polypeptide
ELVMTQTPLSLPVTPGEPASISCRSSQSLLHSNGYNYLDWYLQKPGQSPQLLIYLGSNRASGVPDRFSGSGSGTDFTLKISRVEAEDVGFYYCMQALQTPRTFGQGTKVEIK

SEQ ID NO: 9517 - DNA, 255 bp, Artificial Sequence
  Description of Artificial Sequence: Synthetic polynucleotide
gagctcgtgatgacccagtctccactctccctgcccgtcacccctggagagccggcctccatctcctgcaggtctagtcagagcctcctgcatagaaatggatacaattatttggattggtacttgcataaaccagggcagtctccacagctcctgatctatttgggttctaatcgggcctccggggtccctgacaggttcagtggcagtggatcaggcacagattttacactaaaaatcagcagagtggaggct

SEQ ID NO: 9518 - protein, 112 aa, Artificial Sequence
  Description of Artificial Sequence: Synthetic polypeptide
ELVMTQSPLSLPVTPGEPASISCRSSQSLLHRNGYNYLDWYLHKPGQSPQLLIYLGSNRASGVPDRFSGSGSGTDFTLKISRVEAEDVGVYYCMQALQTPRTFGQGTKVEIK

SEQ ID NO: 9519 - DNA, 255 bp, Artificial Sequence
  Description of Artificial Sequence: Synthetic polynucleotide
gagctcgtgatgactcagactccactctccctgcccgtcacccctggagagccggcctccatctcctgcaggtctagtcagagcctcctgcatagaaatggttacaattatttggattggtacctgcagaagccagggcagtctccacagctcctgatctatttgggttctaatcgggcctccggggtccctgacaggttcattggcagtggctcaggcacagattttacactgaaaatcagcagagtggaggct

SEQ ID NO: 9520 - protein, 111 aa, Artificial Sequence
  Description of Artificial Sequence: Synthetic polypeptide
ELVMTQTPLSLPVTPGEPASISCRSSQSLLHRNGYNYLDWYLQKPGQSPQLLIYLGSNRASGVPDRFIGSGSGTDFTLKISRVEAEDVGVYYCMQALQTPSFGQGTKVEIK

SEQ ID NO: 9521 - DNA, 255 bp, Artificial Sequence
  Description of Artificial Sequence: Synthetic polynucleotide
gagctcgtgatgactcagactccactctccctgcccgtcacccctggagagccggcctccatctcctgcaggtctagtcagagcctcctgcatagaaatggatacaactatttggattggtacctgcagaagccagggcaatctccacagctcctgatctatttgggttctaatcgggcctccggggtccctgacaggttcagtggcagtggatcaggcacagattttacactgaaaatcagcagagtggaggct

SEQ ID NO: 9522 - protein, 112 aa, Artificial Sequence
  Description of Artificial Sequence: Synthetic polypeptide
ELVMTQTPLSLPVTPGEPASISCRSSQSLLHRNGYNYLDWYLQKPGQSPQLLIYLGSNRASGVPDRFSGSGSGTDFTLKISRVEAEDAGVYYCMQSLHLPPTFGGGTKLEIK

SEQ ID NO: 9523 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcatcgtaatggataccactatttggattggtacctgcagaagccaggccagtctccacagctcctgatctatttgggttctaatcgggcctccggggtcccatcaaggttcagtggcagtggatcaggcacagattttacactgaaaatcagcagagtggaggct

SEQ ID NO: 9524 - protein, 112 aa, Artificial Sequence
  Description of Artificial Sequence: Synthetic polypeptide
ELVLTQSPLSLPVTPGEPASISCRSSQSLLHRNGYHYLDWYLQKPGQSPQLLIYLGSNRASGVPSRFSGSGSGTDFTLKISRVEAEDVGIYYCMQALQTPFTFGPGTKVEIK

SEQ ID NO: 9525 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgcatagaaatggatacaactatttggattggtacctgcagaagccagggcagtctccacagctcctgatctatttgggttctaatcgggcctccggggtccctgacaggttcagtggcagtggatcaggcacagatttcacgctgaaaatcagcagagtggaggct

SEQ ID NO: 9526 - protein, 112 aa, Artificial Sequence
  Description of Artificial Sequence: Synthetic polypeptide
ELVMTQSPLSLPVTPGEPASISCRSSQSLLHRNGYNYLDWYLQKPGQSPQLLIYLGSNRASGVPDRFSGSGSGTDFTLKISRVEAEDVGIYYCMQALQTPFTFGPGTKVEIK

SEQ ID NO: 9527 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgcatagtactggatacaactatttggattggtacctgcagaagccagggcagtctccacagctcctgatctatttgggttctaatcgggcctccggggtccctgacaggttcagtggcagtggatcaggcacagattttacactaaaaatcagcagagtggaggct

SEQ ID NO: 9528 - protein, 112 aa, Artificial Sequence
  Description of Artificial Sequence: Synthetic polypeptide
ELVMTQSPLSLPVTPGEPASISCRSSQSLLHSTGYNYLDWYLQKPGQSPQLLIYLGSNRASGVPDRFSGSGSGTDFTLKISRVEAEDVGFYYCMQGLQTPRTFGQGTKLEIK

SEQ ID NO: 9529 - DNA, 255 bp, Artificial Sequence; identical to SEQ ID NO: 9503
  Description of Artificial Sequence: Synthetic polynucleotide

SEQ ID NO: 9530 - protein, 107 aa, Artificial Sequence
  Description of Artificial Sequence: Synthetic polypeptide
ELVMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVEIK

SEQ ID NO: 9531 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9532 - protein, 112 aa, Artificial Sequence
  Description of Artificial Sequence: Synthetic polypeptide
ELVMTQSPLSLPVTPGEPASISCRSSQSLLHSNGYNYLDWYLQKPGQSPQLLIYLGSNRASGVPDRFSGSGSGTDFTLKISRVEAEDVGIYYCMQALQTPRTFGQGTKVDIK

SEQ ID NO: 9533 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9534 - protein, 108 aa, Artificial Sequence
  Description of Artificial Sequence: Synthetic polypeptide
ELVLTQPPSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 9535 - DNA, 255 bp, Artificial Sequence
  Description of Artificial Sequence: Synthetic polynucleotide
gagctcgtgctgactcagccgccttcggtgtcagtggccccaggacagacggccaggattacctgtgggggaaacaacattggaagtaaaagtgtgcagtggtaccagcagaagccaggccaggcccctgtgctggtcgtctatgatgataacgaccggccctcagggatccctgagcgattctctggctccaactctgggaacacggctaccctgaccatcagcagggtcgaagccggggatgaggccgacttt

SEQ ID NO: 9536 - protein, 108 aa, Artificial Sequence
  Description of Artificial Sequence: Synthetic polypeptide
ELVLTQPPSVSVAPGQTARITCGGNNIGSKSVQWYQQKPGQAPVLVVYDDNDRPSGIPERFSGSNSGNTATLTISRVEAGDEADFYCQVWDSSSDHVVFGGGTKLTVL

SEQ ID NO: 9537 - DNA, 255 bp, Artificial Sequence
  Description of Artificial Sequence: Synthetic polynucleotide
gagctcgtggtgactcaggagccatcggtgtcagtggccccaggacagacggccaggattacctgtgggggaaacaacattggaagtaaaagtgtgcactggtaccagcagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 9538 - protein, 108 aa, Artificial Sequence
  Description of Artificial Sequence: Synthetic polypeptide
ELVVTQEPSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 9539 - DNA, 255 bp, Artificial Sequence
  Description of Artificial Sequence: Synthetic polynucleotide
gagctcgtgctgactcagctaccctcggtgtcagtggccccaggacagacggccaggattacctgtgggggaaacaacattggaagtaaaagtgtgcactggcaccagcagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 9540 - protein, 108 aa, Artificial Sequence
  Description of Artificial Sequence: Synthetic polypeptide
ELVLTQLPSVSVAPGQTARITCGGNNIGSKSVHWHQQKPGQAPVMVVYDDNDRPSGIPERFSGSNSGNTATLTISRVEAGDEADYHCQVWDSSSDHVVFGGGTKLTVL

SEQ ID NO: 9541 - DNA, 255 bp, Artificial Sequence
  Description of Artificial Sequence: Synthetic polynucleotide
gagctcgtgctgactcaatcatcctcggtgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactctgggaacacggccaccctgaccatcagcagggtcgaagccggggatgaggccgacttt

SEQ ID NO: 9542 - protein, 108 aa, Artificial Sequence
  Description of Artificial Sequence: Synthetic polypeptide
ELVLTQSSSVSVAPGQTARITCGGNNIGSKSVHWYQQKPGQAPVLVVYDDNDRPSGIPERFSGSNSGNTATLTISRVEAGDEADFYCQVWDSSSDHVVFGGGTKLTVL

SEQ ID NO: 9543 - DNA, 255 bp, Artificial Sequence
  Description of Artificial Sequence: Synthetic polynucleotide
gagctcgtgctgactcagccaccctcggtgtcagtgaccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgaccatcagcagggtcgaagccggggatgaggccgactat

SEQ ID NO: 9544 - protein, 108 aa, Artificial Sequence
  Description of Artificial Sequence: Synthetic polypeptide
ELVLTQPPSVSVTPGQTARITCGGNNIGSKSVHWYQQKPGQAPVLVVYDDNDRPSGIPERFSGSNFGNTATLTISRVEAGDEADYYCQVWDSSSDHVVFGGGTKLTVL

SEQ ID NO: 9545 - DNA, 255 bp, Artificial Sequence
  Description of Artificial Sequence: Synthetic polynucleotide
gagctcgtgctgactcagctaccctcggtgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9546 - protein, 108 aa, Artificial Sequence
  Description of Artificial Sequence: Synthetic polypeptide
ELVLTQLPSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 9547 - DNA, 255 bp, Artificial Sequence
  Description of Artificial Sequence: Synthetic polynucleotide
gagctcatgctgactcagccaccctcggtgtcagtggccccaggacagacggccaggattacctgtgggggaaacaacattggaagtaaaagtgtgcactggtaccagcagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 9548 - protein, 108 aa, Artificial Sequence
  Description of Artificial Sequence: Synthetic polypeptide
ELMLTQPPSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 9549 - DNA, 255 bp, Artificial Sequence
  Description of Artificial Sequence: Synthetic polynucleotide
gagctcatgctgactcagccccactcggtgtcagtggccccaggacagacggccaggattacctgtgggggaaacaacattggaagtaaaagtgtgcactggtaccaacagaagccaggccaggcccctgtgctggtcgtctatgatgataacgaccggccctcagggatccctgagcgattctctggctccaattttgggaacacggccaccctgaccatcagcagggtcgaagccggggatgaggccgactat

SEQ ID NO: 9550 - protein, 108 aa, Artificial Sequence
  Description of Artificial Sequence: Synthetic polypeptide
ELMLTQPHSVSVAPGQTARITCGGNNIGSKSVHWYQQKPGQAPVLVVYDDNDRPSGIPERFSGSNFGNTATLTISRVEAGDEADYYCQVWDSSSDHVVFGGGTKLTVL

SEQ ID NO: 9551 - DNA, 255 bp, Artificial Sequence
  Description of Artificial Sequence: Synthetic polynucleotide
gagctcatgctgactcagccccactcggtgtcagtggccccaggacagacggccaggattacctgtgggggaaacaacattggaagtaaaagtgtgcagtggtaccagcagaagccaggccaggcccctgtgctggtcgtctatgatgataacgaccggccctcagggatccctgagcgattctctggctccaactctgggaacacggctaccctgaccatcagcagggtcgaagccggggatgaggccgacttt

SEQ ID NO: 9552 - protein, 108 aa, Artificial Sequence
  Description of Artificial Sequence: Synthetic polypeptide
ELMLTQPHSVSVAPGQTARITCGGNNIGSKSVQWYQQKPGQAPVLVVYDDNDRPSGIPERFSGSNSGNTATLTISRVEAGDEADFYCQVWDSSSDHVVFGGGTKLTVL

SEQ ID NO: 9553 - DNA, 255 bp, Artificial Sequence
  Description of Artificial Sequence: Synthetic polynucleotide
gagctcatgctgactcagccccactcggtgtcagtggccccaggacagacggccaggattacctgtgggggaaacaacattggaagtaaaagtgtgcactggtaccagcagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 9554 - protein, 108 aa, Artificial Sequence
  Description of Artificial Sequence: Synthetic polypeptide
ELMLTQPHSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 9555 - DNA, 255 bp, Artificial Sequence
  Description of Artificial Sequence: Synthetic polynucleotide
gagctcgtgctgacgcagccgccctcggtgtcagtggccccaggacagacggccaggattacctgtgggggaaacaacattggaagtaaaagtgtgcagtggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgacttt

SEQ ID NO: 9556 - protein, 108 aa, Artificial Sequence
  Description of Artificial Sequence: Synthetic polypeptide
ELVLTQPPSVSVAPGQTARITCGGNNIGSKSVQWYQQKPGQAPVLVVYDDNDRPSGIPERFSGSNFGNTATLIISRVEAGDEADFYCQVWDSSSDHVVFGGGTKLTVL

SEQ ID NO: 9557 - DNA, 255 bp, Artificial Sequence
  Description of Artificial Sequence: Synthetic polynucleotide
gagctcgtgctgacgcagccgccctcggtgtcagtggccccaggacagacggccaggattacctgtgggggaaacaacattggaagtaaaagtgtgcactggtaccagcagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 9558 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNSGNTATLTISRVEAGDEADYYCQVWDSSSDHAVFGGGTKLTVL

SEQ ID NO: 9559 - DNA, 255 bp, Artificial Sequence; identical to SEQ ID NO: 9553
  Description of Artificial Sequence: Synthetic polynucleotide

SEQ ID NO: 9560 - protein, 108 aa, Artificial Sequence; identical to SEQ ID NO: 9554
  Description of Artificial Sequence: Synthetic polypeptide

SEQ ID NO: 9561 - DNA, 255 bp, Artificial Sequence
  Description of Artificial Sequence: Synthetic polynucleotide
gagctcgtgctgactcagccggcttcggtgtcagtggccccaggacagacggccaggattacctgtgggggaaacaacattggaattaaaagtgtgcactggtaccagcagaagccaggccaggcccctgtcctggtcgtctatgatgataacgaccggccctcagggatccctgagcgattctctggctccaactctgggaacacggccaccctgaccatcagcagggtcgaagccggggatgaggccgactat

SEQ ID NO: 9562 - protein, 108 aa, Artificial Sequence
  Description of Artificial Sequence: Synthetic polypeptide
ELVLTQPASVSVAPGQTARITCGGNNIGIKSVHWYQQKPGQAPVLVVYDDNDRPSGIPERFSGSNSGNTATLTISRVEAGDEADYYCQVWDSSSDHVVFGGGTKLTVL

SEQ ID NO: 9563 - DNA, 255 bp, Artificial Sequence
  Description of Artificial Sequence: Synthetic polynucleotide
gagctcgtgctgactcagtcctcctcggtgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9564 - protein, 108 aa, Artificial Sequence
  Description of Artificial Sequence: Synthetic polypeptide
ELVLTQSSSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 9565 - DNA, 255 bp, Artificial Sequence
  Description of Artificial Sequence: Synthetic polynucleotide
gagctcatgctgactcagccccactcggtgtcagtggccccaggacagacggccaggattacctgtgggggaaacaacattggaagtaaaagtgtgcactggtaccagcagaagccaggccaggcccctgtgatggtcgtctatgatgataacgaccggccctcagggatccctgagcgattctctggctccaactctgggaacacggccaccctgattatcagtagggtcgaagccggggatgaggccgactat

SEQ ID NO: 9566 - protein, 108 aa, Artificial Sequence
  Description of Artificial Sequence: Synthetic polypeptide
ELMLTQPHSVSVAPGQTARITCGGNNIGSKSVHWYQQKPGQAPVMVVYDDNDRPSGIPERFSGSNSGNTATLIISRVEAGDEADYYCQVWDSSSDHVVFGGGTKLTVL

SEQ ID NO: 9567 - DNA, 255 bp, Artificial Sequence
  Description of Artificial Sequence: Synthetic polynucleotide
gagctcgccctgactcagcctgcctccgcgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9568 - protein, 108 aa, Artificial Sequence
  Description of Artificial Sequence: Synthetic polypeptide
ELALTQPASASVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 9569 - DNA, 255 bp, Artificial Sequence
  Description of Artificial Sequence: Synthetic polynucleotide
gagctcgtgctgacacagctatcctcggtgtcagtggccccaggacagacggccaggattacctgtgggggaaacaacattggaagtaaaagtgtgcagtggtaccagcagaagccaggccagtcccctgtgatggtcgtctatgatgataacgaccggccctcagggatccctgagcgattctccggctccaactctgggaacacggccaccctgaccatcagcagggtcgaagccggggatgaggccgactat

SEQ ID NO: 9570 - protein, 108 aa, Artificial Sequence
  Description of Artificial Sequence: Synthetic polypeptide
ELVLTQLSSVSVAPGQTARITCGGNNIGSKSVQWYQQKPGQSPVMVVYDDNDRPSGIPERFSGSNSGNTATLTISRVEAGDEADYHCQVWDSSSDHVIFGGGTKLTVL

SEQ ID NO: 9571 - DNA, 255 bp, Artificial Sequence
  Description of Artificial Sequence: Synthetic polynucleotide
gagctcgtggtgactcaggagccctcggtgtcagtggccccaggacagacggccaggattacctgtgggggaaacaacattggaagtaaaagtgtgcactggtaccagcagaagccaggccaggcccctgtgatggtcgtctatgatgataacgaccggccctcagggatccctgagcgattctctggctccaactttgggaacacggccaccctgattatcagtagggtcgaagccggggatgaggccgactat

SEQ ID NO: 9572 - protein, 108 aa, Artificial Sequence
  Description of Artificial Sequence: Synthetic polypeptide
ELVVTQEPSVSVAPGQTARITCGGNNIGSKSVHWYQQKPGQAPVMVVYDDNDRPSGIPERFSGSNFGNTATLIISRVEAGDEADYYCQVWDSNSDHVVFGGGTKLTVL

SEQ ID NO: 9573 - DNA, 255 bp, Artificial Sequence
  Description of Artificial Sequence: Synthetic polynucleotide
gagctcatgctgactcagccaccctcggtgtcagtggccccaggacagacggccaggattacctgtgggggaaacaacattggaagtaaaagtgtgcactggtaccagcagaagccaggccaggcccctgtactggtcgtctatgatgataacgaccggccctcagggatccctgagcgattctctggctccaactctgggaacacggccaccctgaccatcagcagggtcgaagccggggatgaggccgactat

SEQ ID NO: 9574 - protein, 108 aa, Artificial Sequence
  Description of Artificial Sequence: Synthetic polypeptide
ELMLTQPPSVSVAPGQTARITCGGNNIGSKSVHWYQQKPGQAPVLVVYDDNDRPSGIPERFSGSNSGNTATLTISRVEAGDEADYYCQVWDSSSDHVIFGGGTKLTVL

SEQ ID NO: 9575 - DNA, 255 bp, Artificial Sequence
  Description of Artificial Sequence: Synthetic polynucleotide
gagctcgtgctgactcagccaccctcggtgtcagtggccccaggacagacggccaggataacctgtgggggaaacaacattggaagtaaaagtgtgcactggtaccaacagaagccaggccaggcccctgtgatggtcgtctatgatgataacgaccggccctcagggatccctgagcgattctctggctccaactctgggaacacggctaccctgaccatcagcagggtcgaagccggggatgaggccgactat

SEQ ID NO: 9576 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNSGNTATLTISRVEAGDEADYHCQVWDSSSDHVVFGGGTKLTVL

SEQ ID NO: 9577 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaacaacattggaagtaaaagtgtgcagtggtaccagcagaagccaggccaggcccctgtgctggtcgtctatgatgataacgaccggccctcagggatccctgagcgattctctggctccaactttgggaacacggccaccctgattatcagcagggtcgaagccggggatgaggccgactat

SEQ ID NO: 9578 - protein, 108 aa, Artificial Sequence
  Description of Artificial Sequence: Synthetic polypeptide
ELVLTQPPSVSVAPGQTARITCGGNNIGSKSVQWYQQKPGQAPVLVVYDDNDRPSGIPERFSGSNFGNTATLIISRVEAGDEADYYCQVWDSSSDHVVFGGGTKLTVL

SEQ ID NO: 9579 - DNA, 255 bp, Artificial Sequence
  Description of Artificial Sequence: Synthetic polynucleotide
gagctcgtgctgactcagccggcttcggtgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9580 - protein, 108 aa, Artificial Sequence
  Description of Artificial Sequence: Synthetic polypeptide
ELVLTQPASVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 9581 - DNA, 255 bp, Artificial Sequence; identical to SEQ ID NO: 9553
  Description of Artificial Sequence: Synthetic polynucleotide

SEQ ID NO: 9582 - protein, 108 aa, Artificial Sequence; identical to SEQ ID NO: 9554
  Description of Artificial Sequence: Synthetic polypeptide

SEQ ID NO: 9583 - DNA, 255 bp, Artificial Sequence
  Description of Artificial Sequence: Synthetic polynucleotide
gagctcgtgctgactcagtccccctcggtgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9584 - protein, 108 aa, Artificial Sequence
  Description of Artificial Sequence: Synthetic polypeptide
ELVLTQSPSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 9585 - DNA, 255 bp, Artificial Sequence
  Description of Artificial Sequence: Synthetic polynucleotide
gagctcgccctgactcagcctccctccgtgtcagtggccccaggacagacggccaggattacctgtgggggaaacaacattggaagtaaaagtgtgcactggtaccagcagaagccaggccaggcccctgtcctggtcgtctatgatgataacgaccggccctcagggatccctgagcgattctctggctccaactctgggaacacggccaccctgaccatcagcagggtcgaagccggggatgaggccgactat

SEQ ID NO: 9586 - protein, 108 aa, Artificial Sequence
  Description of Artificial Sequence: Synthetic polypeptide
ELALTQPPSVSVAPGQTARITCGGNNIGSKSVHWYQQKPGQAPVLVVYDDNDRPSGIPERFSGSNSGNTATLTISRVEAGDEADYYCQVWDSSSDHVMFGGGTKLTVL

SEQ ID NO: 9587 - DNA, 255 bp, Artificial Sequence
  Description of Artificial Sequence: Synthetic polynucleotide
gagctcgtgttgacgcagccgccctcggtgtcagtggccccaggacagacggccaggattacctgtgggggaaacaacattggaagtaaaagtgtgcactggtaccagcagaagccaggccaggcccctgtgatggtcgtctatgatgataacgaccggccctcagggatccctgagcgattctctggctccaactttgggaacacggccaccctgattatcagtagggtcgaagccggggatgaggccgactat

SEQ ID NO: 9588 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNFGNTATLIISRVEAGDEADYYCQVWDSSSDHVVFGGGTKLTVL

SEQ ID NO: 9589 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaacaacattggaagtaaaagtgtgcactggcaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9590 - protein, 108 aa, Artificial Sequence
  Description of Artificial Sequence: Synthetic polypeptide
ELVLTQPPSVSVAPGQTARITCGGNNIGSKSVHWHQQKPGQAPVLVVYDDNDRPSGIPERFSGSNFGNTATLIISRVEAGDEADYYCQVWDSSSDHVVFGGGTKLTVL

SEQ ID NO: 9591 - DNA, 255 bp, Artificial Sequence; identical to SEQ ID NO: 9533
  Description of Artificial Sequence: Synthetic polynucleotide

SEQ ID NO: 9592 - protein, 108 aa, Artificial Sequence; identical to SEQ ID NO: 9534
  Description of Artificial Sequence: Synthetic polypeptide

SEQ ID NO: 9593 - DNA, 255 bp, Artificial Sequence
  Description of Artificial Sequence: Synthetic polynucleotide
gagctcgtgctgactcagccggcttcggtgtcagtggccccaggacagacggccaggattacctgtgggggaaacaacattggaagtaaaagtgtgcactggtaccagcagaagccaggccaggcccctgtgatggtcgtctatgatgataacgaccggccctcagggatccctgagcgattctctggctccaactttgggaacacggccaccctgattatcagtagggtcgaagccggggatgaggccgactat

SEQ ID NO: 9594 - protein, 108 aa, Artificial Sequence
  Description of Artificial Sequence: Synthetic polypeptide
ELVLTQPASVSVAPGQTARITCGGNNIGSKSVHWYQQKPGQAPVMVVYDDNDRPSGIPERFSGSNFGNTATLIISRVEAGDEADYYCQVWDSSSDHVVFGGGTKLTVL

SEQ ID NO: 9595 - DNA, 255 bp, Artificial Sequence
  Description of Artificial Sequence: Synthetic polynucleotide
gagctcgccctgactcagcctgcctccgcgtcagtggccccaggacagacggccaggatttcctgtgggggaaacaacattggaagtaaaggtgtgcagtggtaccagcagaagccaggccaggcccctgtactggtcgtctatgatgataacgaccggccctcagggatccctgagcgattctctggctccaactttgggaacacggccaccctgattatcagtagggtcgaagccggggatgaggccgactat

SEQ ID NO: 9596 - protein, 108 aa, Artificial Sequence
  Description of Artificial Sequence: Synthetic polypeptide
ELALTQPASASVAPGQTARISCGGNNIGSKGVQWYQQKPGQAPVLVVYDDNDRPSGIPERFSGSNFGNTATLIISRVEAGDEADYYCQVWDSSSDHVVFGGGTKLTVL

SEQ ID NO: 9597 - DNA, 255 bp, Artificial Sequence
  Description of Artificial Sequence: Synthetic polynucleotide
gagctcgtgctgacgcagccgccctcggtgtcagtggccccaggacagacggccaggattacctgtgggggaaacaacattggaagtaaaagtgtgcagtggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9598 - protein, 108 aa, Artificial Sequence; identical to SEQ ID NO: 9578
  Description of Artificial Sequence: Synthetic polypeptide

SEQ ID NO: 9599 - DNA, 255 bp, Artificial Sequence
  Description of Artificial Sequence: Synthetic polynucleotide
gagctcgtggtgactcaggagccctcggtgtcagtggccccaggacagacggccaggattacctgtgggggaaacaacattggaagtaaaagtgtgcactggcaccagcagaagccaggccaggcccctgtgttggtcgtctatgatgataacgaccggccctcagggatccctgagcgattctctggctccaactctgggaacacggccaccctgaccatcagcagggtcgaagccggggatgaggccgacttt

SEQ ID NO: 9600 - protein, 108 aa, Artificial Sequence
  Description of Artificial Sequence: Synthetic polypeptide
ELVVTQEPSVSVAPGQTARITCGGNNIGSKSVHWHQQKPGQAPVLVVYDDNDRPSGIPERFSGSNSGNTATLTISRVEAGDEADFYCQVWDSSSDHVVFGGGTKLTVL

SEQ ID NO: 9601 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaact

SEQ ID NO: 9602 - protein, 107 aa, Artificial Sequence
  Description of Artificial Sequence: Synthetic polypeptide
ELVMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVEIK

SEQ ID NO: 9603 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccgggcgagtcagggcattagcaattatttagcctggtatcagcagaaaccagggaaagttcctaagctcctgatctctgctgcatccactttgcaatcaggggtcccatctcggttcagtggcagtggatctgggacagatttcactctcaccatcagcagcctgcagcctgaagatgttgcaact

SEQ ID NO: 9604 - protein, 107 aa, Artificial Sequence
  Description of Artificial Sequence: Synthetic polypeptide
ELVMTQSPSSLSASVGDRVTITCRASQGISNYLAWYQQKPGKVPKLLISAASTLQSGVPSRFSGSGSGTDFTLTISSLQPEDVATYYCQKYNSAPFTFGPGTKLEIK

SEQ ID NO: 9605 - DNA, 255 bp, Artificial Sequence
  Description of Artificial Sequence: Synthetic polynucleotide
gagctcgtgatgacccagtctccatcctccctgtctgcatctgttggagacagagtcaccatcacttgccgggcgagtcagggcattagcaattatttagcctggtatcagcagaaaccagggaaagttcctaagctcctgatctctgctgcatccactttgcaatcaggggtcccatctcggttcagtggcagtggatctgggacagatttcactctcaccatcagcagcctgcagcctgaagatgttgcaact

SEQ ID NO: 9606 - protein, 107 aa, Artificial Sequence
  Description of Artificial Sequence: Synthetic polypeptide
ELVMTQSPSSLSASVGDRVTITCRASQGISNYLAWYQQKPGKVPKLLISAASTLQSGVPSRFSGSGSGTDFTLTISSLQPEDVATYYCQKYNSAPFTFGPGTKVDIK

SEQ ID NO: 9607 - DNA, 255 bp, Artificial Sequence
  Description of Artificial Sequence: Synthetic polynucleotide
gagctcgtgctgactcagccgccctcggtgtcagtggccccaggacagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactat

SEQ ID NO: 9608 - protein, 109 aa, Artificial Sequence
  Description of Artificial Sequence: Synthetic polypeptide
ELVLTQPPSVSVAPGQTARITCGGNNIGSKSVHWYQQKPGQAPVLVVYDDSDRPSGIPERFSGSNSGNTATLTISRVEAGDEADYYCQVWDSSSDHHVVFGGGTKLTVL

SEQ ID NO: 9609 - DNA, 255 bp, Artificial Sequence
  Description of Artificial Sequence: Synthetic polynucleotide
gagctcgtgctgactcagccaccctcggtgtcagtggccccaggacagacggccaggataacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9610 - protein, 108 aa, Artificial Sequence; identical to SEQ ID NO: 9534
  Description of Artificial Sequence: Synthetic polypeptide

SEQ ID NO: 9611 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaacaacattggaagtaaaagtgtgcactggcaccagcagaagccaggccaggcccctgtgttggtcgtctatgatgataacgaccggccctcagggatccctgagcgattctctggctccaactctgggaacacggccaccctgaccatcagcagggtcgaggccggggatgaggccgacttt

SEQ ID NO: 9612 - protein, 108 aa, Artificial Sequence
  Description of Artificial Sequence: Synthetic polypeptide
ELVLTQPPSVSVAPGQTARITCGGNNIGSKSVHWHQQKPGQAPVLVVYDDNDRPSGIPERFSGSNSGNTATLTISRVEAGDEADFYCQVWDSSSDHVVFGGGTKLTVL

SEQ ID NO: 9613 - DNA, 255 bp, Artificial Sequence
  Description of Artificial Sequence: Synthetic polynucleotide
gagctcgtgctgactcaaccctcctcggtgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgcagccggggatgaggccgactat

SEQ ID NO: 9614 - protein, 108 aa, Artificial Sequence
  Description of Artificial Sequence: Synthetic polypeptide
ELVLTQPSSVSVAPGQTARITCGGNNIGSKSVHWYQQKPGQAPVLVVYDDNDRPSGIPERFSGSNFGNTATLIISRVAAGDEADYYCQVWDSSSDHVVFGGGTKLTVL

SEQ ID NO: 9615 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaataacattggaagtaaaagtgtgcactggcaccagcagaagccaggccagtcccctgtgttggtcatctatgatgataacgaccggccctcagggatccctgagcgattctctggcttcaactctgggaacacggccaccctgaccatcagcagggtcgaagccggggatgaggccgactat

SEQ ID NO: 9616 - protein, 108 aa, Artificial Sequence
  Description of Artificial Sequence: Synthetic polypeptide
ELVLTQPPSVSVAPGQTARITCGGNNIGSKSVHWHQQKPGQSPVLVIYDDNDRPSGIPERFSGFNSGNTATLTISRVEAGDEADYYCQVWDSSSDHVVFGGGTKLTVL

SEQ ID NO: 9617 - DNA, 255 bp, Artificial Sequence
  Description of Artificial Sequence: Synthetic polynucleotide
gagctcgtgctgactcagccaccctcggtgtcagtggccccaggacagacggccaggataacctgtgggggaaacaacattggaagtaaaagtgtgcactggtaccaacagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 9618 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNSGNTATLTISRVEAGDEADYYCQVWDSSSDHVIFGGGTKLTVL

SEQ ID NO: 9619 - DNA, 255 bp, Artificial Sequence
  Description of Artificial Sequence: Synthetic polynucleotide
gagctcatgctgactcagccccactcggtgtcagtggccccaggacagacggccaggattacctgtgggggaaacaacattggaagtaaaagtgtgcactggtaccagcagaagccaggccaggcccctgtgctggtcgtctatgatgataacgaccggccctcagggatccctgagcgattctctggctccaactttgggaacacggccaccctgattatcagtagggtcgaagccggggatgaggccgactat

SEQ ID NO: 9620 - protein, 108 aa, Artificial Sequence
  Description of Artificial Sequence: Synthetic polypeptide
ELMLTQPHSVSVAPGQTARITCGGNNIGSKSVHWYQQKPGQAPVLVVYDDNDRPSGIPERFSGSNFGNTATLIISRVEAGDEADYYCQVWDSSSDHVVFGGGTKLTVL

SEQ ID NO: 9621 - DNA, 255 bp, Artificial Sequence; identical to SEQ ID NO: 9617
  Description of Artificial Sequence: Synthetic polynucleotide

SEQ ID NO: 9622 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNSGNTATLTISRVEAGDEADYYCQVWDSSSDHVVFGGGTKLTVL

SEQ ID NO: 9623 - DNA, 255 bp, Artificial Sequence
  Description of Artificial Sequence: Synthetic polynucleotide
gagctcgccctgactcagcctgcctccgcgtcagtggccccaggacagacggccaggattacctgtgggggaaacaacattggaagtaaaagtgtgcactggcaccagcagaagccaggccaggcccctgtgttggtcgtctatgatgataacgaccggccctcagggatccctgagcgattctctggctccaactctgggaacacggccaccctgaccatcagcagggtcgaagccggggatgaggccgacttt

SEQ ID NO: 9624 - protein, 108 aa, Artificial Sequence
  Description of Artificial Sequence: Synthetic polypeptide
ELALTQPASASVAPGQTARITCGGNNIGSKSVHWHQQKPGQAPVLVVYDDNDRPSGIPERFSGSNSGNTATLTISRVEAGDEADFYCQVWDSSSDHVVFGGGTKLTVL

SEQ ID NO: 9625 - DNA, 255 bp, Artificial Sequence
  Description of Artificial Sequence: Synthetic polynucleotide
gagctcgtgttgacgcagccgccctcggtgtcagtggccccaggacagacggccaggattacctgtgggggaaacaacattggaagtaaaagtgtgcactggcaccagcagaagccaggccaggcccctgtgttggtcgtctatgatgataacgaccggccctcagggatccctgagcgattctctggctccaactctgggaacacggccaccctgaccatcagcagggtcgaagccggggatgaggccgactat

SEQ ID NO: 9626 - protein, 108 aa, Artificial Sequence
  Description of Artificial Sequence: Synthetic polypeptide
ELVLTQPPSVSVAPGQTARITCGGNNIGSKSVHWHQQKPGQAPVLVVYDDNDRPSGIPERFSGSNSGNTATLTISRVEAGDEADYYCQVWDYSSDHVVFGGGTKLTVL

SEQ ID NO: 9627 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaacaacattggaagtaaaagtgtgcactggcaccagcagaagccaggccaggcccctgtgttggtcgtctatgatgataacgaccggccctcagggatccctgagcgattctctggctccaactctgggaacacggccaccctgaccatcagcagggtcgaagccggggatgaggccgactat

SEQ ID NO: 9628 - protein, 108 aa, Artificial Sequence; identical to SEQ ID NO: 9626
  Description of Artificial Sequence: Synthetic polypeptide

SEQ ID NO: 9629 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaacaacattggaagtaaaagtgtgcactggtaccagcagaagccaggccaggcccctgtactggtcgtctatgatgataacgaccggccctcagggatccctgagcgattctctggctccaactttgggaacacggccaccctgattatcagtagggtcgcagccggggatgaggccgactat

SEQ ID NO: 9630 - protein, 108 aa, Artificial Sequence
  Description of Artificial Sequence: Synthetic polypeptide
ELVLTQPPSVSVAPGQTARITCGGNNIGSKSVHWYQQKPGQAPVLVVYDDNDRPSGIPERFSGSNFGNTATLIISRVAAGDEADYYCQVWDSSSDHVVFGGGTKLTVL

SEQ ID NO: 9631 - DNA, 255 bp, Artificial Sequence; identical to SEQ ID NO: 9557
  Description of Artificial Sequence: Synthetic polynucleotide

SEQ ID NO: 9632 - protein, 108 aa, Artificial Sequence; identical to SEQ ID NO: 9622
  Description of Artificial Sequence: Synthetic polypeptide

SEQ ID NO: 9633 - DNA, 255 bp, Artificial Sequence; identical to SEQ ID NO: 9423
  Description of Artificial Sequence: Synthetic polynucleotide

SEQ ID NO: 9634 - protein, 113 aa, Artificial Sequence
  Description of Artificial Sequence: Synthetic polypeptide
ELVMTQSPDSLAVSLGERATINCKSSQSVLYSSNNKNYLAWYQQKPGQPPKLLIYWASTRESGVPDRFSGSGSGTDFTLTISSLQAEDVAVYYCQQFYSTPITFGQGTRLEIK

SEQ ID NO: 9635 - DNA, 255 bp, Artificial Sequence
  Description of Artificial Sequence: Synthetic polynucleotide
gagctcgtgatgactcagactccagactccctggctgtgtctctgggcgagagggccaccatcaactgcaagtccagccagagtgttttatacagctccaacaataaaaactacttagcttggtaccagcagaaaccaggacagcctcctaagctgctcatttactgggcatctacccgggaatccggggtccctgaccgattcagtggcagcgggtctgggacagatttcactctcaccatcagcagcctgcag

SEQ ID NO: 9636 - protein, 113 aa, Artificial Sequence
  Description of Artificial Sequence: Synthetic polypeptide
ELVMTQTPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 9637 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccgggcaagtcagagcattagcaactatttcaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaact

SEQ ID NO: 9638 - protein, 107 aa, Artificial Sequence
  Description of Artificial Sequence: Synthetic polypeptide
ELVMTQSPSSLSASVGDRVTITCRASQSISNYFNWYQQKPGKAPKLLIYAASSLQSGVPSRFSGSGSGTDFTLTISSLQPEDFATYYCQQSYITPFTFGGGTKLEIK

SEQ ID NO: 9639 - DNA, 255 bp, Artificial Sequence
  Description of Artificial Sequence: Synthetic polynucleotide
gagctccagatgacccagtctccttcctccctgtctgcatctgtaggagacagagtcaccatcacttgccgggcaagtcagtttattagcagctatttaaattggtatcagcagaaaccagggaaagcccctaagctcctgatctatgctgcatccagtttgcaaagtggggtcccatcaaggttcagtggccgtggatctgggacagatttcactctcaccatcagcagtctgcaacctgaagattttgcaact

SEQ ID NO: 9640 - protein, 107 aa, Artificial Sequence
  Description of Artificial Sequence: Synthetic polypeptide
ELQMTQSPSSLSASVGDRVTITCRASQFISSYLNWYQQKPGKAPKLLIYAASSLQSGVPSRFSGRGSGTDFTLTISSLQPEDFATYYCQQSYSTPFTFGPGTKVEIK

SEQ ID NO: 9641 - DNA, 255 bp, Artificial Sequence
  Description of Artificial Sequence: Synthetic polynucleotide
gagctcgtgatgacccagtctccagactccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaact

SEQ ID NO: 9642 - protein, 107 aa, Artificial Sequence
  Description of Artificial Sequence: Synthetic polypeptide
ELVMTQSPDSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 9643 - DNA, 255 bp, Artificial Sequence; identical to SEQ ID NO: 9467
  Description of Artificial Sequence: Synthetic polynucleotide

SEQ ID NO: 9644 - protein, 107 aa, Artificial Sequence
  Description of Artificial Sequence: Synthetic polypeptide
ELQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVEIK

SEQ ID NO: 9645 - DNA, 255 bp, Artificial Sequence
  Description of Artificial Sequence: Synthetic polynucleotide
gagctccagatgacccagtctccatcctccctgtctgcatctgtaggagacagagtcaccatcacttgccaggcgagtcaggacattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaact

SEQ ID NO: 9646 - protein, 107 aa, Artificial Sequence
  Description of Artificial Sequence: Synthetic polypeptide
ELQMTQSPSSLSASVGDRVTITCQASQDISNYLNWYQQKPGKAPKLLIYAASSLQSGVPSRFSGSGSGTDFTLTISSLQPEDFATYYCQQSYTTPFTFGPGTKVEIK

SEQ ID NO: 9647 - DNA, 255 bp, Artificial Sequence; identical to SEQ ID NO: 9451
  Description of Artificial Sequence: Synthetic polynucleotide

SEQ ID NO: 9648 - protein, 107 aa, Artificial Sequence; identical to SEQ ID NO: 9452
  Description of Artificial Sequence: Synthetic polypeptide

SEQ ID NO: 9649 - DNA, 255 bp, Artificial Sequence; identical to SEQ ID NO: 9645
  Description of Artificial Sequence: Synthetic polynucleotide

SEQ ID NO: 9650 - protein, 107 aa, Artificial Sequence
  Description of Artificial Sequence: Synthetic polypeptide
ELQMTQSPSSLSASVGDRVTITCQASQDISNYLNWYQQKPGKAPKLLIYAASSLQSGVPSRFSGSGSGTDFTLTISSLQPEDFATYYCQQSYSIPLTFGGGTKVEIK

SEQ ID NO: 9651 - DNA, 255 bp, Artificial Sequence; identical to SEQ ID NO: 9503
  Description of Artificial Sequence: Synthetic polynucleotide

SEQ ID NO: 9652 - protein, 107 aa, Artificial Sequence; identical to SEQ ID NO: 9504
  Description of Artificial Sequence: Synthetic polypeptide

SEQ ID NO: 9653 - DNA, 255 bp, Artificial Sequence
  Description of Artificial Sequence: Synthetic polynucleotide
gagctccagatgacccagtctccatcctccctgtctgcatctgtaggagacagagtcaccatcacttgccggacaagtcagagcattagcagctatttaaattggtttcaacagaaaccagggaaagcccctaagctcctgatctttgctgcatccagtttgcaaagtggggtcccatcaaggttcagtggcagtggatctgggacagatttcactctcaccatcagcagtctgcaacctgaagattttgcaact

SEQ ID NO: 9654 - protein, 107 aa, Artificial Sequence
  Description of Artificial Sequence: Synthetic polypeptide
ELQMTQSPSSLSASVGDRVTITCRTSQSISSYLNWFQQKPGKAPKLLIFAASSLQSGVPSRFSGSGSGTDFTLTISSLQPEDFATYYCQQSYSSPFTFGPGTKVEIK

SEQ ID NO: 9655 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccggacaagtcagagcattagcagctatttaaattggtttcaacagaaaccagggaaagcccctaagctcctgatctttgctgcatccagtttgcaaagtggggtcccatcaaggttcagtggcagtggatctgggacagatttcactctcaccatcagcagtctccaacctgaagattttgcaact

SEQ ID NO: 9656 - protein, 107 aa, Artificial Sequence
  Description of Artificial Sequence: Synthetic polypeptide
ELVMTQSPSSLSASVGDRVTITCRTSQSISSYLNWFQQKPGKAPKLLIFAASSLQSGVPSRFSGSGSGTDFTLTISSLQPEDFATYYCQQTYSMPFTFGPGTKVEIK

SEQ ID NO: 9657 - DNA, 255 bp, Artificial Sequence; identical to SEQ ID NO: 9507
  Description of Artificial Sequence: Synthetic polynucleotide

SEQ ID NO: 9658 - protein, 107 aa, Artificial Sequence
  Description of Artificial Sequence: Synthetic polypeptide
ELQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 9659 - DNA, 255 bp, Artificial Sequence; identical to SEQ ID NO: 9503
  Description of Artificial Sequence: Synthetic polynucleotide

SEQ ID NO: 9660 - protein, 107 aa, Artificial Sequence; identical to SEQ ID NO: 9504
  Description of Artificial Sequence: Synthetic polypeptide

SEQ ID NO: 9661 - DNA, 255 bp, Artificial Sequence; identical to SEQ ID NO: 9503
  Description of Artificial Sequence: Synthetic polynucleotide

SEQ ID NO: 9662 - protein, 107 aa, Artificial Sequence; identical to SEQ ID NO: 9504
  Description of Artificial Sequence: Synthetic polypeptide

SEQ ID NO: 9663 - DNA, 255 bp, Artificial Sequence
  Description of Artificial Sequence: Synthetic polynucleotide
gagctcgtgatgacccagactccactctccctgcccgtcacccctggagagccggcctccatctcctgcaggtctagtcagagcctcctgcatagaaatggatacaactatttggattggtacctgcagaagccagggcagtctccacagctcctgatctatttgggttctaatcgggcctccggggtccctgacaggttcagtggcagtggatcaggcacagatttcacgctgaaaatcagcagagtggaggct

SEQ ID NO: 9664 - protein, 112 aa, Artificial Sequence
  Description of Artificial Sequence: Synthetic polypeptide
ELVMTQTPLSLPVTPGEPASISCRSSQSLLHRNGYNYLDWYLQKPGQSPQLLIYLGSNRASGVPDRFSGSGSGTDFTLKISRVEAGDVGVYYCMQALQTPWTFGQGTKVEIK

SEQ ID NO: 9665 - DNA, 255 bp, Artificial Sequence
  Description of Artificial Sequence: Synthetic polynucleotide
gagctcgtgatgactcagtctccactctccctgcccgtcacccctggagagccggcctccatctcctgcaggtctagtcagagcctcctgcatagtactggatacaactatgtggattggtacctgcagaagccagggcagtctccacagctcctgatctatttgggttctaatcgggcctccggggtccctgacaggttcagtggcagtggatcaggcacagattttacactaaaaatcagcagagtggaggct

SEQ ID NO: 9666 - protein, 112 aa, Artificial Sequence
  Description of Artificial Sequence: Synthetic polypeptide
ELVMTQSPLSLPVTPGEPASISCRSSQSLLHSTGYNYVDWYLQKPGQSPQLLIYLGSNRASGVPDRFSGSGSGTDFTLKISRVEAEDVGFYYCMQALQTPRTFGQGTKVEIK

SEQ ID NO: 9667 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccggacaagtcagagcattagcagctatttaaattggtatcagcagaaaccagggaaagcccctaaactcctgatctatgctgcatccagtttgcaaagtggggtcccatcaaggttcagtggcagtggatctgggacagatttcactctcaccatcagcagtctccaacctgaagattttgcaact

SEQ ID NO: 9668 - protein, 107 aa, Artificial Sequence
  Description of Artificial Sequence: Synthetic polypeptide
ELVMTQSPSSLSASVGDRVTITCRTSQSISSYLNWYQQKPGKAPKLLIYAASSLQSGVPSRFSGSGSGTDFTLTISSLQPEDFATYYCQQTYSMPFTFGGGTKVEIK

SEQ ID NO: 9669 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccggacaagtcagagcattagcagctatttaaattggtatcagcagaaaccagggagagcccctaagctcctgatctttgctgcatccagtttgcaaggtggggtcccatcaaggttcagtggcagtggatctgggacagatttcactctcaccatcagcagtctgcaacctgaagattttgcaact

SEQ ID NO: 9670 - protein, 107 aa, Artificial Sequence
  Description of Artificial Sequence: Synthetic polypeptide
ELVMTQSPSSLSASVGDRVTITCRTSQSISSYLNWYQQKPGRAPKLLIFAASSLQGGVPSRFSGSGSGTDFTLTISSLQPEDFATYYCQQSYSSPFTFGPGTKVEIK

SEQ ID NO: 9671 - DNA, 255 bp, Artificial Sequence; identical to SEQ ID NO: 9503
  Description of Artificial Sequence: Synthetic polynucleotide

SEQ ID NO: 9672 - protein, 107 aa, Artificial Sequence
  Description of Artificial Sequence: Synthetic polypeptide
ELVMTQSPSSLSASVGDRVTITCRTSQSISSYLNWYQQKPGRAPKLLIFAASSLQGGVPSRFSGSGSGTDFTLTISSLQPEDFATYYCQQTYSSPFTFGPGTKLEIK

SEQ ID NO: 9673 - DNA, 255 bp, Artificial Sequence
  Description of Artificial Sequence: Synthetic polynucleotide
gagctcgtgatgacccagtctccactctccctgcccgtcacccctggagagccggcctccatctcctgcaggtctagtcagagcctcctgcatagtagtggatacaactatttggattggtacctgcagaagccagggcagtctccacagctcctgatctatttgggttctaatcgggcctccggggtccctgacaggttcagtggcagtggatcaggcacagattttacactgaaaatcagcaaagtggaggct

SEQ ID NO: 9674 - protein, 112 aa, Artificial Sequence
  Description of Artificial Sequence: Synthetic polypeptide
ELVMTQSPLSLPVTPGEPASISCRSSQSLLHSSGYNYLDWYLQKPGQSPQLLIYLGSNRASGVPDRFSGSGSGTDFTLKISKVEAEDVGVYYCMQALQTPRTFGQGTKVDIK

SEQ ID NO: 9675 - DNA, 255 bp, Artificial Sequence
  Description of Artificial Sequence: Synthetic polynucleotide
gagctcgtgctgactcagtctccactctccctgcccgtcacccctggagagccggcctccatctcctgcaggtctagtcagagcctcctgcacagaaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggct

SEQ ID NO: 9676 - protein, 112 aa, Artificial Sequence
  Description of Artificial Sequence: Synthetic polypeptide
ELVLTQSPLSLPVTPGEPASISCRSSQSLLHRNGYNYLDWYLQKPGQSPQLLIYLGSNRASGVPDRFSGSGSGTDFTLKISRVEAEDVGVYYCMQGLQTPFTFGPGTKVEIK

SEQ ID NO: 9677 - DNA, 255 bp, Artificial Sequence
  Description of Artificial Sequence: Synthetic polynucleotide
gagctcgtgatgactcagactccactctccctgcccgtcacccctggagagccggcctccatctcctgcaggtctagtcagagcctcctgcatagaaatggatacaattatttggattggtacctgcagaagccagggcagtctccacagctcctgatctatttgggttctaatcgggcctccggggtccctgacaggttcattggcagtggctcaggcacagattttacactggaaatcagcagagtggaggct

SEQ ID NO: 9678 - protein, 111 aa, Artificial Sequence
  Description of Artificial Sequence: Synthetic polypeptide
ELVMTQTPLSLPVTPGEPASISCRSSQSLLHRNGYNYLDWYLQKPGQSPQLLIYLGSNRASGVPDRFIGSGSGTDFTLEISRVEAEDVGVYYCMQALQTPSFGQGTKVEIK

SEQ ID NO: 9679 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccgggcaagtcagagcattagcagctatttaaattggtatcagcagaaaccagggagagcccctaagctcctgatctttgctgcatccagtttgcaaggtggggtcccatcaaggttcagtggcagtggatctgggacagatttcactctcaccatcagcagtctccaacctgaagattttgcaact

SEQ ID NO: 9680 - protein, 107 aa, Artificial Sequence
  Description of Artificial Sequence: Synthetic polypeptide
ELVMTQSPSSLSASVGDRVTITCRASQSISSYLNWYQQKPGRAPKLLIFAASSLQGGVPSRFSGSGSGTDFTLTISSLQPEDFATYYCQQTYSMPFTFGPGTKLEIK

SEQ ID NO: 9681 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNFGNTATLIISRVAAGDEADYYCQVWDYRYLSQVFGGGTKLTVL

SEQ ID NO: 9682 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGGGTKLTVL

SEQ ID NO: 9683 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVEIK

SEQ ID NO: 9684 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDADRPSGIPERFSGSNSGNTATLTISRVEAGDEADYYCQVWDASAGYGVVFGGGTKLTVL

SEQ ID NO: 9685 - protein, 112 aa, Artificial Sequence
  Description of Artificial Sequence: Synthetic polypeptide
DIVMTQTPLSLPVTPGEPASISCRSSQSLLHRSGYNYLDWYLQKPGQSPQLLIYLGSNRASGVPDRFSGSGSGTDFTLKISRVEAGDVGVYYCMQALQTPWTFGQGTKVEIK

SEQ ID NO: 9686 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFYSTPITFGQGTRLEIK

SEQ ID NO: 9687 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGGGTKLTVL

SEQ ID NO: 9688 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGGGTKLTVL

SEQ ID NO: 9689 - protein, 108 aa, Artificial Sequence; identical to SEQ ID NO: 9688
  Description of Artificial Sequence: Synthetic polypeptide

SEQ ID NO: 9690 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYYSNRAVFGGGTKLTVL

SEQ ID NO: 9691 - protein, 108 aa, Artificial Sequence; identical to SEQ ID NO: 9681
  Description of Artificial Sequence: Synthetic polypeptide

SEQ ID NO: 9692 - protein, 108 aa, Artificial Sequence; identical to SEQ ID NO: 9681
  Description of Artificial Sequence: Synthetic polypeptide

SEQ ID NO: 9693 - protein, 108 aa, Artificial Sequence; identical to SEQ ID NO: 9682
  Description of Artificial Sequence: Synthetic polypeptide

SEQ ID NO: 9694 - protein, 108 aa, Artificial Sequence; identical to SEQ ID NO: 9682
  Description of Artificial Sequence: Synthetic polypeptide

SEQ ID NO: 9695 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQSYSSPFTFGPGTKVEIK

SEQ ID NO: 9696 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASSLQSGVPSRFSGRGSGTDFTLTISSLQPEDFATYYCQQSYYYPTLFGPGTKVEIK

SEQ ID NO: 9697 - protein, 107 aa, Artificial Sequence
  Description of Artificial Sequence: Synthetic polypeptide
DIQMTQSPSSLSASVGDRVTITCQASQDISNYFNWYQQKPGKAPKLLIYAASSLQSGVPSRFSGSGSGTDFTLTISSLQPEDFATYYCQQSYITPFTFGPGTKVEIK

SEQ ID NO: 9698 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASSLQSGVPSRFSGSGSGTDFTLTISSLQPEDFATYYCQQSYFPVVEFGPGTKVEIK

SEQ ID NO: 9699 - protein, 107 aa, Artificial Sequence
  Description of Artificial Sequence: Synthetic polypeptide
DIQMTQSPSSLSASVGDRVTITCQASQDISNYLNWYQQKPGKAPKLLIYAASSLQSGVPSRFSGRGSGTDFTLTISSLQPEDFATYYCQQSYTPPTTFGPGTKVEIK

SEQ ID NO: 9700 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGGGTKVEIK

SEQ ID NO: 9701 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCIQAYTSPFTFGPGTKLEIK

SEQ ID NO: 9702 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGPGTKVDIK

SEQ ID NO: 9703 - protein, 107 aa, Artificial Sequence; identical to SEQ ID NO: 9702
  Description of Artificial Sequence: Synthetic polypeptide

SEQ ID NO: 9704 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDNDRPSGIPERFSGSNSGNTATLTISRVEAGDEADYYCQVWDYVAPRHVFGGGTKLTVL

SEQ ID NO: 9705 - protein, 108 aa, Artificial Sequence; identical to SEQ ID NO: 9704
  Description of Artificial Sequence: Synthetic polypeptide

SEQ ID NO: 9706 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQSGVPSRFSGSGSGTDFTLTISSLQPEDFATYYCQQTYSMPFTFGPGTKVDIK

SEQ ID NO: 9707 - protein, 107 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQTYSSPFTFGPGTKLEIK

SEQ ID NO: 9708 - protein, 107 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDFATYYCQKYNSAPFTFGPGTKVEIK

SEQ ID NO: 9709 - DNA, 255 bp, Artificial Sequence; identical to SEQ ID NO: 6845
  Description of Artificial Sequence: Synthetic polynucleotide

SEQ ID NO: 9710 - protein, 120 aa, Artificial Sequence
  Description of Artificial Sequence: Synthetic polypeptide
EVQLLEQSGPELVKPGASVKISCKASGYAFSKSWMNWVKQRPGKGLEWIGRIYPGDGDTNYNGKFKGKAALTADKSSNTANMQLNSLTSEDSAVYFCARDGVFYAPLAYWGQGTLVTVSS

SEQ ID NO: 9711 - DNA, 255 bp, Artificial Sequence; identical to SEQ ID NO: 6847
  Description of Artificial Sequence: Synthetic polynucleotide

SEQ ID NO: 9712 - protein, 123 aa, Artificial Sequence
  Description of Artificial Sequence: Synthetic polypeptide
EVQLLEQSGPELVKPGASVKISCKASDYTFSKSWMNWVKQRPGEGLEWIGRVWPGDGDTTYNEKFKGKATLTADKSSRTAYMQLSSLTSEDSAVYFCARGNYFGSSEAYFDYWGQGTRVTVSS

SEQ ID NO: 9713 - DNA, 255 bp, Artificial Sequence; identical to SEQ ID NO: 6849
  Description of Artificial Sequence: Synthetic polynucleotide

SEQ ID NO: 9714 - protein, 121 aa, Artificial Sequence
  Description of Artificial Sequence: Synthetic polypeptide
EVQLLEQSGPELVKPGASVKISCKASGYAFSSSWMNWVKQRPGKGLEWIGRIYPGDGDTNYNGKFKDKATLTADKSSNTAYMQLSSLTSEDSAVYFCARRQLNHVFAMDYWGQGTSVTVSS

SEQ ID NO: 9715 - DNA, 255 bp, Artificial Sequence; identical to SEQ ID NO: 6851
  Description of Artificial Sequence: Synthetic polynucleotide

SEQ ID NO: 9716 - protein, 123 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTGYAQKFQGRVTMTRNTSISTAYMELSSLRSEDTAVYYCARGGGYSNGYDYGMDVWGQGTTVTVSS

SEQ ID NO: 9717 - DNA, 255 bp, Artificial Sequence; identical to SEQ ID NO: 6853
  Description of Artificial Sequence: Synthetic polynucleotide

SEQ ID NO: 9718 - protein, 123 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTGYAQKFQGRVTMTRNTSISTAYMELSSLRSEDTAVYYCARGGGYSYGYDYGMDVWGQGTTVTVSS

SEQ ID NO: 9719 - DNA, 255 bp, Artificial Sequence; identical to SEQ ID NO: 6855
  Description of Artificial Sequence: Synthetic polynucleotide

SEQ ID NO: 9720 - protein, 122 aa, Artificial Sequence
  Description of Artificial Sequence: Synthetic polypeptide
EVQLLEWGAGLLKPSETLSLTCAVYGGSFSGYYWNWIRQPPGKGLEWIGEISHSGSTNYNPSLKSRVSISGDTSKNQFSLKLSSVTAADTAVYYCARGGGYSHGYDYGMDVWGQGTTVTVSS

SEQ ID NO: 9721 - DNA, 255 bp, Artificial Sequence; identical to SEQ ID NO: 6857
  Description of Artificial Sequence: Synthetic polynucleotide

SEQ ID NO: 9722 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDITYYADSVKGRFTISRDNSKNTLYLQMNSLRAEDTAVYYCAKHLRYFDWPLDYWGQGTLVTVSS

SEQ ID NO: 9723 - DNA, 255 bp, Artificial Sequence; identical to SEQ ID NO: 6859
  Description of Artificial Sequence: Synthetic polynucleotide

SEQ ID NO: 9724 - protein, 121 aa, Artificial Sequence
  Description of Artificial Sequence: Synthetic polypeptide
EVQLLESGGGVVQPGRSLRLSCAASGFTFRSYRMHWVRQAPGKGLEWVAVISYDGGNKYYADSVKGRFTISRDNSKNTLYLQMNSLRAEDTAVYYCAREQWPNYYYGMDVWGQGTTVTVSS

SEQ ID NO: 9725 - DNA, 255 bp, Artificial Sequence; identical to SEQ ID NO: 6861
  Description of Artificial Sequence: Synthetic polynucleotide

SEQ ID NO: 9726 - protein, 122 aa, Artificial Sequence
  Description of Artificial Sequence: Synthetic polypeptide
EVQLLEWGAGLLKPSETLSLTCAVYGGSFSGYYWNWIRQPPGKGLEWIGEINHSGSTNYNPSLKSRVTISVDTSKNQFSLKLSSVTAADTAVYYCARGGGYSYGYDYGMDVWGQGTTVTVSS

SEQ ID NO: 9727 - DNA, 255 bp, Artificial Sequence; identical to SEQ ID NO: 6863
  Description of Artificial Sequence: Synthetic polynucleotide

SEQ ID NO: 9728 - protein, 126 aa, Artificial Sequence
  Description of Artificial Sequence: Synthetic polypeptide
EVQLLESGGGLVQPGGSLRLSCAASGFTFSSYAMSWVRQAPGRGLEWVSTISGSGGSTDYADSVKGRFTISRDNSKNTLYLQMNSLRAEDTAVYYCAKDGGSGWFPKLLHYGLDVWGQGTTVTVSS

SEQ ID NO: 9729 - DNA, 255 bp, Artificial Sequence; identical to SEQ ID NO: 6865
  Description of Artificial Sequence: Synthetic polynucleotide

SEQ ID NO: 9730 - protein, 123 aa, Artificial Sequence
  Description of Artificial Sequence: Synthetic polypeptide
EVQLLESGAEVKKPGASVKVSCMASGYTFTGYDINWVRQATGQGLEWMGWMNPNRGTTGYAQKFQGRVTMTRNTSISTAYMELSSLRSEDTAVYYCARGGGYSYGYDYGMDVWGQGTTVTVSS

SEQ ID NO: 9731 - DNA, 255 bp, Artificial Sequence; identical to SEQ ID NO: 6867
  Description of Artificial Sequence: Synthetic polynucleotide

SEQ ID NO: 9732 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGDYTYYADSVKGRFTISRDNSKNTLYLQMNSLRAEDTAVYYCAKHLRYSDWPLDYWGQGTLVTVSS

SEQ ID NO: 9733 - DNA, 255 bp, Artificial Sequence; identical to SEQ ID NO: 6869
  Description of Artificial Sequence: Synthetic polynucleotide

SEQ ID NO: 9734 - protein, 122 aa, Artificial Sequence
  Description of Artificial Sequence: Synthetic polypeptide
EVQLLEWGAGLLKPSETLSLTCAVYGGSFSGYYWTWIRQPPGKGLEWIGEINHSGRTNYNPSLKSRVTMSEDTAKNQFSLKLSSVTAADTAVYYCARGGGYSDGYDYGMDVWGQGTTVTVSS

SEQ ID NO: 9735 - DNA, 255 bp, Artificial Sequence; identical to SEQ ID NO: 6871
  Description of Artificial Sequence: Synthetic polynucleotide

SEQ ID NO: 9736 - protein, 122 aa, Artificial Sequence
  Description of Artificial Sequence: Synthetic polypeptide
EVQLLEWGAGLLKPSETLSLTCAVYGGSFSGYYWNWIRQPPGKGLEWIGEINHRGSTNYNPSLKSRVTISVDASKNQFSLKLSSVTAADTAVYYCARGGGYSDGYDYGMDVWGQGTTVTVSS

SEQ ID NO: 9737 - DNA, 255 bp, Artificial Sequence; identical to SEQ ID NO: 6861
  Description of Artificial Sequence: Synthetic polynucleotide

SEQ ID NO: 9738 - protein, 122 aa, Artificial Sequence; identical to SEQ ID NO: 9726
  Description of Artificial Sequence: Synthetic polypeptide

SEQ ID NO: 9739 - DNA, 255 bp, Artificial Sequence; identical to SEQ ID NO: 6875
  Description of Artificial Sequence: Synthetic polynucleotide

SEQ ID NO: 9740 - protein, 122 aa, Artificial Sequence
  Description of Artificial Sequence: Synthetic polypeptide
EVQLLEWGAGLLKPSETLSLTCGVYGGSFSGYYWSWIRQPPGKGLEWIGEINHRGSTNYNPSLKSRVTISVDASKNQFSLKLSSVTAADTAVYYCARGGGYSYGYDYGMDVWGQGTTVTVSS

SEQ ID NO: 9741 - DNA, 255 bp, Artificial Sequence; identical to SEQ ID NO: 6877
  Description of Artificial Sequence: Synthetic polynucleotide

SEQ ID NO: 9742 - protein, 121 aa, Artificial Sequence
  Description of Artificial Sequence: Synthetic polypeptide
EVQLLESGGGLVQPGGSLRLSCAASGFTFSSYGMSWVRQAPGKGLEWVSAISGSGGSTYYADSAKGRFTISRDNSKNTLYLQMNSLRAEDTAVYYCAKLVTPDYYYGMDVWGQGTTVTVSS

SEQ ID NO: 9743 - DNA, 255 bp, Artificial Sequence; identical to SEQ ID NO: 6879
  Description of Artificial Sequence: Synthetic polynucleotide

SEQ ID NO: 9744 - protein, 122 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDTSKNQFSLKLSSVTAADTAVYYCARGGGYSYGYDYGMDVWGQGTTVTVSS

SEQ ID NO: 9745 - DNA, 255 bp, Artificial Sequence; identical to SEQ ID NO: 6851
  Description of Artificial Sequence: Synthetic polynucleotide

SEQ ID NO: 9746 - protein, 123 aa, Artificial Sequence; identical to SEQ ID NO: 9716
  Description of Artificial Sequence: Synthetic polypeptide

SEQ ID NO: 9747 - DNA, 255 bp, Artificial Sequence; identical to SEQ ID NO: 6883
  Description of Artificial Sequence: Synthetic polynucleotide

SEQ ID NO: 9748 - protein, 122 aa, Artificial Sequence
  Description of Artificial Sequence: Synthetic polypeptide
EVQLLEWGAGLLKPSETLSLTCAVYGGSFSGYYWNWIRQPPGKGLEWIGEINHSGSTTYNPSLKSRVTISEDTSRNQFSLKLSSVTAADTAVYYCTRGGGYSHGYDYGMDVWGQGTTVTVSS

SEQ ID NO: 9749 - DNA, 255 bp, Artificial Sequence; identical to SEQ ID NO: 6885
  Description of Artificial Sequence: Synthetic polynucleotide

SEQ ID NO: 9750 - protein, 122 aa, Artificial Sequence
  Description of Artificial Sequence: Synthetic polypeptide
EVQLLEWGAGLLKPSETLSLTCAVYGGSFSGFYWNWIRQPPGKGLEWIGEINHRGSTNYNPSLKSRVTISVDASKNQFSLKLSSVTAADTAVYYCARGGGYSDGYDYGMDVWGQGTTVTVSS

SEQ ID NO: 9751 - DNA, 255 bp, Artificial Sequence; identical to SEQ ID NO: 6855
  Description of Artificial Sequence: Synthetic polynucleotide

SEQ ID NO: 9752 - protein, 122 aa, Artificial Sequence; identical to SEQ ID NO: 9720
  Description of Artificial Sequence: Synthetic polypeptide

SEQ ID NO: 9753 - DNA, 255 bp, Artificial Sequence; identical to SEQ ID NO: 6889
  Description of Artificial Sequence: Synthetic polynucleotide

SEQ ID NO: 9754 - protein, 122 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDASKNQFSLKLSSVTAADTAVYYCARGGGYSDGYDYGMDVWGQGTTVTVSS

SEQ ID NO: 9755 - DNA, 255 bp, Artificial Sequence; identical to SEQ ID NO: 6891
  Description of Artificial Sequence: Synthetic polynucleotide

SEQ ID NO: 9756 - protein, 122 aa, Artificial Sequence
  Description of Artificial Sequence: Synthetic polypeptide
EVQLLEWGAGLLKPSETLSLTCAVYGGSFSGYYWSWIRQPPGKGLEWIGEITHSGSTNYNPSLKSRVTISVDTSKNLFSLKLSSVTAADTAVYYCARGGGYSDGYDYGMDVWGQGTTVTVSS

SEQ ID NO: 9757 - DNA, 255 bp, Artificial Sequence; identical to SEQ ID NO: 6893
  Description of Artificial Sequence: Synthetic polynucleotide

SEQ ID NO: 9758 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYFCAKVMTPDYYYDMDVWGQGTTVTVSS

SEQ ID NO: 9759 - DNA, 255 bp, Artificial Sequence; identical to SEQ ID NO: 6895
  Description of Artificial Sequence: Synthetic polynucleotide

SEQ ID NO: 9760 - protein, 121 aa, Artificial Sequence
  Description of Artificial Sequence: Synthetic polypeptide
EVQLLESGGGLVQPGGSLRLSCAASGFTFSSYGMSWVRQAPGKGLEWVSAISGSGGSTYYADSVKGRFTISRDNSKNTLYLQMNSLRAEDTAVYFCAKVMTPDYYYDMDVWGQGTTVTVSS

SEQ ID NO: 9761 - DNA, 255 bp, Artificial Sequence; identical to SEQ ID NO: 6879
  Description of Artificial Sequence: Synthetic polynucleotide

SEQ ID NO: 9762 - protein, 122 aa, Artificial Sequence; identical to SEQ ID NO: 9744
  Description of Artificial Sequence: Synthetic polypeptide

SEQ ID NO: 9763 - DNA, 255 bp, Artificial Sequence; identical to SEQ ID NO: 6899
  Description of Artificial Sequence: Synthetic polynucleotide

SEQ ID NO: 9764 - protein, 126 aa, Artificial Sequence
  Description of Artificial Sequence: Synthetic polypeptide
EVQLLESGPGLVKPSQTLSLTCTVSGDSISRDPYYWSWIRQHPGKGLEWIGYIYYSGSTYYNPSLKSRVTISVDTSKNQFSLKLSSVTAADTAVYYCARDKLWFGKLNYYYGMDVWGQGTTVTVSS

SEQ ID NO: 9765 - DNA, 255 bp, Artificial Sequence; identical to SEQ ID NO: 6901
  Description of Artificial Sequence: Synthetic polynucleotide

SEQ ID NO: 9766 - protein, 122 aa, Artificial Sequence
  Description of Artificial Sequence: Synthetic polypeptide
EVQLLEWGAGLLKPSETLSLTCAVYGGSFSGYYWSWIRQPPGKGLEWIGEINHSGSTNYNPSLKSRVTISVDPSKNQFSLKLSSVTAADTAVYYCARGGGYSYGYDYGMDVWGQGTTVTVSS

SEQ ID NO: 9767 - DNA, 255 bp, Artificial Sequence; identical to SEQ ID NO: 6861
  Description of Artificial Sequence: Synthetic polynucleotide

SEQ ID NO: 9768 - protein, 122 aa, Artificial Sequence; identical to SEQ ID NO: 9726
  Description of Artificial Sequence: Synthetic polypeptide

SEQ ID NO: 9769 - DNA, 255 bp, Artificial Sequence; identical to SEQ ID NO: 6905
  Description of Artificial Sequence: Synthetic polynucleotide

SEQ ID NO: 9770 - protein, 121 aa, Artificial Sequence; identical to SEQ ID NO: 5050
  Description of Artificial Sequence: Synthetic polypeptide

SEQ ID NO: 9771 - DNA, 255 bp, Artificial Sequence; identical to SEQ ID NO: 6907
  Description of Artificial Sequence: Synthetic polynucleotide

SEQ ID NO: 9772 - protein, 122 aa, Artificial Sequence
  Description of Artificial Sequence: Synthetic polypeptide
EVQLLEWGAGLLKPSETLSLTCAVYGGSLSGYYWSWIRQPPGKGLEWIGEINHSGRTNYNPSLKSRVTMSEDTAKNQFSLKLSSVTAADTAVYYCARGGGYSDGYDYGMDVWGQGTTVTVSS

SEQ ID NO: 9773 - DNA, 255 bp, Artificial Sequence; identical to SEQ ID NO: 6879
  Description of Artificial Sequence: Synthetic polynucleotide

SEQ ID NO: 9774 - protein, 122 aa, Artificial Sequence; identical to SEQ ID NO: 9744
  Description of Artificial Sequence: Synthetic polypeptide

SEQ ID NO: 9775 - DNA, 255 bp, Artificial Sequence; identical to SEQ ID NO: 6911
  Description of Artificial Sequence: Synthetic polynucleotide

SEQ ID NO: 9776 - protein, 122 aa, Artificial Sequence
  Description of Artificial Sequence: Synthetic polypeptide
EVQLLEWGAGLLKPSETLSLTCGVYGGSFSGYYWNWIRQPPGKGLEWIGEINHRGSTNYNPSLKSRVTISVDASKNQFSLKLSSVTAADTAVYYCARGGGYSDGYDYGMDVWGQGTTVTVSS

SEQ ID NO: 9777 - DNA, 255 bp, Artificial Sequence; identical to SEQ ID NO: 6853
  Description of Artificial Sequence: Synthetic polynucleotide

SEQ ID NO: 9778 - protein, 123 aa, Artificial Sequence; identical to SEQ ID NO: 9718
  Description of Artificial Sequence: Synthetic polypeptide

SEQ ID NO: 9779 - DNA, 255 bp, Artificial Sequence; identical to SEQ ID NO: 6915
  Description of Artificial Sequence: Synthetic polynucleotide

SEQ ID NO: 9780 - protein, 126 aa, Artificial Sequence
  Description of Artificial Sequence: Synthetic polypeptide
EVQLLESGGGVVQPGRSLRLSCAASGFTFSRYGMDWVRQAPGKGLEWVALIWYDGSNKYYADSVKGRFTISRDNSKNTLYLQMNSLRAEDTAVYYCARNYGSGSYGAYYYHGMDVWGQGTTVTVSS

SEQ ID NO: 9781 - DNA, 255 bp, Artificial Sequence; identical to SEQ ID NO: 6917
  Description of Artificial Sequence: Synthetic polynucleotide

SEQ ID NO: 9782 - protein, 121 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTDYAQKFQGRVTMTRNTSISTAYMELSSLRSEDTAVYYCVRGWGTYYYYGMDVWGQGTTVTVSS

SEQ ID NO: 9783 - DNA, 255 bp, Artificial Sequence; identical to SEQ ID NO: 6919
  Description of Artificial Sequence: Synthetic polynucleotide

SEQ ID NO: 9784 - protein, 121 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTDYAQKFQGRVTMTRNTSISTAYMELSSLRSEDTAVYYCARGWGRYYSYGMDVWGQGTTVTVSS

SEQ ID NO: 9785 - DNA, 255 bp, Artificial Sequence; identical to SEQ ID NO: 6921
  Description of Artificial Sequence: Synthetic polynucleotide

SEQ ID NO: 9786 - protein, 120 aa, Artificial Sequence; identical to SEQ ID NO: 9722
  Description of Artificial Sequence: Synthetic polypeptide

SEQ ID NO: 9787 - DNA, 255 bp, Artificial Sequence; identical to SEQ ID NO: 6923
  Description of Artificial Sequence: Synthetic polynucleotide

SEQ ID NO: 9788 - protein, 121 aa, Artificial Sequence
  Description of Artificial Sequence: Synthetic polypeptide
EVQLLESGGGLVKPGGSLRLSCAASGFTFSGYSMNWVRQAPGKGLEWVSSISSSSSYIYYADSVKGRFTISRDNAKNSLYLQMNSLRAEDTAVYYCVRSKAARPDDGMDVWGQGTTVTVSS

SEQ ID NO: 9789 - DNA, 255 bp, Artificial Sequence; identical to SEQ ID NO: 6925
  Description of Artificial Sequence: Synthetic polynucleotide

SEQ ID NO: 9790 - protein, 126 aa, Artificial Sequence
  Description of Artificial Sequence: Synthetic polypeptide
EVQLLESGGGLVQPGGSLRLSCAASGFTFSSYAMSWVRQAPGRGLEWVSSITITGGSTYYADSVKGRFTISRDNSKNTLNLQMNSLRAEDTAVYYCAKDGGSGWFPKLLHYGLDVWGQGTTVTVSS

SEQ ID NO: 9791 - DNA, 255 bp, Artificial Sequence; identical to SEQ ID NO: 6927
  Description of Artificial Sequence: Synthetic polynucleotide

SEQ ID NO: 9792 - protein, 126 aa, Artificial Sequence
  Description of Artificial Sequence: Synthetic polypeptide
EVQLLESGGGVVQPGRSLRLSCAASGFTFSRYGMQWVRQAPGKGLEWVAVISYDGSNKYYADSVKGRFTISRDNSKNTLYLQMNSLRAEDTAVYYCARNYGSGSYGAYYYHGMDVWGQGTTVTVSS

SEQ ID NO: 9793 - DNA, 255 bp, Artificial Sequence; identical to SEQ ID NO: 6929
  Description of Artificial Sequence: Synthetic polynucleotide

SEQ ID NO: 9794 - protein, 121 aa, Artificial Sequence
  Description of Artificial Sequence: Synthetic polypeptide
EVQLLESGGGVVQPGRSLRLSCAASGFTFSSYGMHWVRQAPGKGLEWVAVISYDGSNKYYADSVKGRFTISRDNSKNTLFLQMNSLRTEDTAVYYCAREQWPNYYYGLGVWGQGTTVTVSS

SEQ ID NO: 9795 - DNA, 255 bp, Artificial Sequence; identical to SEQ ID NO: 6931
  Description of Artificial Sequence: Synthetic polynucleotide

SEQ ID NO: 9796 - protein, 121 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTDYAQKFQGRVTMTRNTSISTAYMELRSLRSEDTAVYYCARGWGRFYSYGMDVWGQGTTVTVSS

SEQ ID NO: 9797 - DNA, 255 bp, Artificial Sequence; identical to SEQ ID NO: 6933
  Description of Artificial Sequence: Synthetic polynucleotide

SEQ ID NO: 9798 - protein, 121 aa, Artificial Sequence
  Description of Artificial Sequence: Synthetic polypeptide
EVQLLESGAEVKKPGASVKVSCKASGYTFTSYDINWVRQATGQGLEWMGWMNPNSGNTDYTQKFQGRVTMTRNTSIGTAYMELSSLRSEDTAVYYCVRGWGTYYYYGMDVWGQGTTVTVSS

SEQ ID NO: 9799 - DNA, 255 bp, Artificial Sequence; identical to SEQ ID NO: 6935
  Description of Artificial Sequence: Synthetic polynucleotide

SEQ ID NO: 9800 - protein, 126 aa, Artificial Sequence
  Description of Artificial Sequence: Synthetic polypeptide
EVQLLESGPGLVKPSQTLSLTCTVSGGSISSGDYYWSWIRQHPGKGLEWIGYINDSGSTYYNPSLKSRVTLSVDSSKNQFSLKLSSVTAADTAVYYCARDLLWFGKLNYYYGMDVWGQGTTVTVSS

SEQ ID NO: 9801 - DNA, 255 bp, Artificial Sequence; identical to SEQ ID NO: 6937
  Description of Artificial Sequence: Synthetic polynucleotide

SEQ ID NO: 9802 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSGISGSGGSTYYADSVKGRFTISRDNSKNTLYLQMNSLRAEDTAVYYCAKVMTPDYYYDMDVWGQGTTVTVSS

SEQ ID NO: 9803 - DNA, 255 bp, Artificial Sequence; identical to SEQ ID NO: 6939
  Description of Artificial Sequence: Synthetic polynucleotide

SEQ ID NO: 9804 - protein, 121 aa, Artificial Sequence
  Description of Artificial Sequence: Synthetic polypeptide
EVQLLESGPGLVKPSETLSLTCTVSGDSISSSRYYWGWIRQPPGKGLEWIGSIYYSGSTYYNPSLKSRVTISVDTSKNQFSLKLSSVTAADTAVYYCARGIFGVITYFDYWGQGTLVTVSS

SEQ ID NO: 9805 - DNA, 255 bp, Artificial Sequence; identical to SEQ ID NO: 6941
  Description of Artificial Sequence: Synthetic polynucleotide

SEQ ID NO: 9806 - protein, 128 aa, Artificial Sequence
  Description of Artificial Sequence: Synthetic polypeptide
EVQLLESGPGQVKPSQTLSLTCAISGDSVSSNSAAWNWIRQSPSRGLEWLGRTYYRSKWYNDYAVSVKSRITINPDTSKNQFSLQLNSVTPEDTAVYYCAREVLWFGKLNYYYGMDVWGQGTTVTVSS

SEQ ID NO: 9807 - DNA, 255 bp, Artificial Sequence; identical to SEQ ID NO: 6943
  Description of Artificial Sequence: Synthetic polynucleotide

SEQ ID NO: 9808 - protein, 121 aa, Artificial Sequence
  Description of Artificial Sequence: Synthetic polypeptide
EVQLLESGPGLVKPSETLSLTCIVSGVSISSSRSYWGWIRQPPGKGLEWIGSIYYGGSTYYNPSLKSRVTISVDTSKNQFSLKLSSVTAADTAVYYCATTIFGVVGWFDPWGQGNLVTVSS

SEQ ID NO: 9809 - DNA, 255 bp, Artificial Sequence; identical to SEQ ID NO: 6945
  Description of Artificial Sequence: Synthetic polynucleotide

SEQ ID NO: 9810 - protein, 123 aa, Artificial Sequence
  Description of Artificial Sequence: Synthetic polypeptide
EVQLLESGPALVKPTQTLTLTCTFSGFSFTTHKMGVDWIRQPPGKALEWLALIYWNDDTRYSPSLQSRLTITKDTSKNQVVLTMTNMDPVDTATYYCVYRRYNWNYENWFDPWGQGTLVTVSS

SEQ ID NO: 9811 - DNA, 255 bp, Artificial Sequence; identical to SEQ ID NO: 6947
  Description of Artificial Sequence: Synthetic polynucleotide

SEQ ID NO: 9812 - protein, 124 aa, Artificial Sequence
  Description of Artificial Sequence: Synthetic polypeptide
EVQLLESGGGLVKPGGSLRLSCAASGFTFSIYALSWVRQAPGKGLEWVSAISGSGGSTYYADSVKGRFTISRDNSKNTLYLQMNSLRAEDTAVYYCAKGEGIAARYYYYGMDVWGQGTTVTVSS

SEQ ID NO: 9813 - DNA, 255 bp, Artificial Sequence; identical to SEQ ID NO: 6949
  Description of Artificial Sequence: Synthetic polynucleotide

SEQ ID NO: 9814 - protein, 126 aa, Artificial Sequence
  Description of Artificial Sequence: Synthetic polypeptide
EVQLLESGGGVVQPGRSLRLSCAASGFTFSRYGMDWVRQAPGKGLEWVAVIWYDGSNKYYADSVKGRFTISRDNSKNTLYLQMNSLRAEDTAVYYCARNYGSGSYGAYYYHGMDVWGQGTTVTVSS

SEQ ID NO: 9815 - DNA, 255 bp, Artificial Sequence; identical to SEQ ID NO: 6951
  Description of Artificial Sequence: Synthetic polynucleotide

SEQ ID NO: 9816 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSAISGSGSSTYYADSVKGRFTISRDNSKNTLYLQMNSLRAEDTAVYYCAKHLRYSDWPLDYWGQGTLVTVSS

SEQ ID NO: 9817 - DNA, 255 bp, Artificial Sequence; identical to SEQ ID NO: 6953
  Description of Artificial Sequence: Synthetic polynucleotide

SEQ ID NO: 9818 - protein, 121 aa, Artificial Sequence
  Description of Artificial Sequence: Synthetic polypeptide
EVQLLESGAEVKKPGASVKVSCKASGYTFTSYDINWVRQATGQGLEWMGWMNPKSGNTGYAQKFQDRVTMTRNTSISTAYMELSSLRSDDTAVYYCVRGWGTYYYYGMDVWGQGTTVTVSS

SEQ ID NO: 9819 - DNA, 255 bp, Artificial Sequence; identical to SEQ ID NO: 6857
  Description of Artificial Sequence: Synthetic polynucleotide

SEQ ID NO: 9820 - protein, 120 aa, Artificial Sequence; identical to SEQ ID NO: 9722
  Description of Artificial Sequence: Synthetic polypeptide

SEQ ID NO: 9821 - DNA, 255 bp, Artificial Sequence; identical to SEQ ID NO: 6879
  Description of Artificial Sequence: Synthetic polynucleotide

SEQ ID NO: 9822 - protein, 122 aa, Artificial Sequence; identical to SEQ ID NO: 9744
  Description of Artificial Sequence: Synthetic polypeptide

SEQ ID NO: 9823 - DNA, 255 bp, Artificial Sequence; identical to SEQ ID NO: 6959
  Description of Artificial Sequence: Synthetic polynucleotide

SEQ ID NO: 9824 - protein, 121 aa, Artificial Sequence
  Description of Artificial Sequence: Synthetic polypeptide
EVQLLESGPGLVKPSETLSLTCIVSGGSISSSRSYWGWIRQPPGKGLEWIGSIYYGGSTYYNPSLKNRVTMSVDTSKNQFSLKLSSVTAADTAVYYCATTIFGVVGWFDPWGQGNLVTVSS

SEQ ID NO: 9825 - DNA, 255 bp, Artificial Sequence; identical to SEQ ID NO: 6961
  Description of Artificial Sequence: Synthetic polynucleotide

SEQ ID NO: 9826 - protein, 123 aa, Artificial Sequence
  Description of Artificial Sequence: Synthetic polypeptide
EVQLLESGPALVKPTQTLTLSCSFSGFSLSTNKMAVGWIRQPPGKALEWLALIYWNDDKRYSPSLKSRLTITKDTSKNQVVLTMTNMDPVDTATYYCARRRYNWNYENWFDPWGQGILVTVSS

SEQ ID NO: 9827 - DNA, 255 bp, Artificial Sequence; identical to SEQ ID NO: 6963
  Description of Artificial Sequence: Synthetic polynucleotide

SEQ ID NO: 9828 - protein, 123 aa, Artificial Sequence
  Description of Artificial Sequence: Synthetic polypeptide
EVQLLESGPVLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSS

SEQ ID NO: 9829 - DNA, 255 bp, Artificial Sequence; identical to SEQ ID NO: 6965
  Description of Artificial Sequence: Synthetic polynucleotide

SEQ ID NO: 9830 - protein, 121 aa, Artificial Sequence
  Description of Artificial Sequence: Synthetic polypeptide
EVQLLESGGGLVQPGGSLRLSCAASGFTFSSYAMSWVRQAPGKGLEWVSGISGSGGSSYYADSVKGRFTISRDNSKNTLYLQMNSLRAEDTAVYYCAKTLTPDYYYDMDVWGQGTTVTVSS

SEQ ID NO: 9831 - DNA, 255 bp, Artificial Sequence; identical to SEQ ID NO: 6967
  Description of Artificial Sequence: Synthetic polynucleotide

SEQ ID NO: 9832 - protein, 121 aa, Artificial Sequence
  Description of Artificial Sequence: Synthetic polypeptide
EVQLLESGGGLVQPGGSLRLSCAASGFTFSSYAVSWVRQAPGKGLEWVSGISGSGGSTYYADSVKGRFTISRDNSKNTLYLQMNSLRAEDTAVYYCAKALTPDYYYDMDVWGQGTTVTVSS

SEQ ID NO: 9833 - DNA, 255 bp, Artificial Sequence; identical to SEQ ID NO: 6969
  Description of Artificial Sequence: Synthetic polynucleotide

SEQ ID NO: 9834 - protein, 125 aa, Artificial Sequence
  Description of Artificial Sequence: Synthetic polypeptide
EVQLLESGGGLVQPGGSLRLSCAASGFTFSNYAMSWVRQAPGKGLEWVSAISGSGGSTYYADSVKGRFTISRDNSKNTLYLQMNSLRAEDTAVYYCAKQGGIAAAYYYYDGMDVWGQGTTVTVSS

SEQ ID NO: 9835 - DNA, 255 bp, Artificial Sequence; identical to SEQ ID NO: 6971
  Description of Artificial Sequence: Synthetic polynucleotide

SEQ ID NO: 9836 - protein, 126 aa, Artificial Sequence
  Description of Artificial Sequence: Synthetic polypeptide
EVQLLESGGGVVQPGRSLRLSCAASGFTFSRYGMDWVRQAPGKGLEWVAVISYDGSNKYYADSVKGRFTISRDNSKNTLYLQMNSLRAEDTAVYYCARNYGSGSYGAYYYYGMDVWGQGTTVTVSS

SEQ ID NO: 9837 - DNA, 255 bp, Artificial Sequence; identical to SEQ ID NO: 6973
  Description of Artificial Sequence: Synthetic polynucleotide

SEQ ID NO: 9838 - protein, 126 aa, Artificial Sequence
  Description of Artificial Sequence: Synthetic polypeptide
EVQLLESGGGLVQPGGSLRLSCAASGFTFTSYAMSWVRQAPGKGLEWVSTISHSGGSTYYADSVKGRFTISRDNSKNTLYLQMNSLRAEDTAVYYCAKDGGSGWFPKLLHYGLDVWGQGTTVTVSS

SEQ ID NO: 9839 - DNA, 255 bp, Artificial Sequence; identical to SEQ ID NO: 6975
  Description of Artificial Sequence: Synthetic polynucleotide

SEQ ID NO: 9840 - protein, 124 aa, Artificial Sequence
  Description of Artificial Sequence: Synthetic polypeptide
EVQLLESGGGLVQPGGSLRLSCAASGFTLSIYGMSWVRQAPGKGLEWVSAISGSGGSTYYADSVKGRFTISRDNSKNTLYLQMNSLRAEDTAVYYCAKGEGISARYYYYGMDVWGQGTTVTVSS

SEQ ID NO: 9841 - DNA, 255 bp, Artificial Sequence; identical to SEQ ID NO: 6977
  Description of Artificial Sequence: Synthetic polynucleotide

SEQ ID NO: 9842 - protein, 126 aa, Artificial Sequence
  Description of Artificial Sequence: Synthetic polypeptide
EVQLLESGPGLVKPSQTLSLTCTVSGDSISSNPYYWSWIRQLPGKGLEWIGYISYSGSTFYNPSLKSRVTISVDTSKNQFSLNLTSVTAADTAVYYCARDRLWFGVLNYYYGMDVWGLGTTVTVSS

SEQ ID NO: 9843 - DNA, 255 bp, Artificial Sequence; identical to SEQ ID NO: 6979
  Description of Artificial Sequence: Synthetic polynucleotide

SEQ ID NO: 9844 - protein, 126 aa, Artificial Sequence
  Description of Artificial Sequence: Synthetic polypeptide
EVQLLESGPGLVKPSETLSLTCTVSGGAISSGDYYWSWIRQHPGKGLEWIGYIDKSGSTYYNPSLKSRATISVDTSKDQFSLKLTSLTAADTAVYYCAREKMWFGVLNYYYGMDVWGQGTTVTVSS

SEQ ID NO: 9845 - DNA, 255 bp, Artificial Sequence; identical to SEQ ID NO: 6981
  Description of Artificial Sequence: Synthetic polynucleotide

SEQ ID NO: 9846 - protein, 126 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRVTISVDTSKNQFSLNLTSVTAADTAVYYCARDRLWFGVLNYYYGMDVWGQGTTVTVSS

SEQ ID NO: 9847 - DNA, 255 bp, Artificial Sequence; identical to SEQ ID NO: 6983
  Description of Artificial Sequence: Synthetic polynucleotide

SEQ ID NO: 9848 - protein, 126 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKDQFSLKLSSVTAADTAVYYCARDQLWFGVLNYYYGMDVWGQGTTVTVSS

SEQ ID NO: 9849 - DNA, 255 bp, Artificial Sequence; identical to SEQ ID NO: 6985
  Description of Artificial Sequence: Synthetic polynucleotide

SEQ ID NO: 9850 - protein, 127 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSNSGSYYNYFSVMDVWGQGTTVTVSS

SEQ ID NO: 9851 - DNA, 255 bp, Artificial Sequence; identical to SEQ ID NO: 6987
  Description of Artificial Sequence: Synthetic polynucleotide

SEQ ID NO: 9852 - protein, 127 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLFLQMNSLKTEDTAVYYCTTPSNSGSYYNYFSVMDVWGQGTTVTVSS

SEQ ID NO: 9853 - DNA, 255 bp, Artificial Sequence; identical to SEQ ID NO: 6983
  Description of Artificial Sequence: Synthetic polynucleotide

SEQ ID NO: 9854 - protein, 126 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKDQFSLKLSSVTAADTAVYYCARDRLWFGVLNYYYGMDVWGPGTTVTVSS

SEQ ID NO: 9855 - DNA, 255 bp, Artificial Sequence; identical to SEQ ID NO: 6983
  Description of Artificial Sequence: Synthetic polynucleotide

SEQ ID NO: 9856 - protein, 126 aa, Artificial Sequence; identical to SEQ ID NO: 9848
  Description of Artificial Sequence: Synthetic polypeptide

SEQ ID NO: 9857 - DNA, 255 bp, Artificial Sequence; identical to SEQ ID NO: 6993
  Description of Artificial Sequence: Synthetic polynucleotide

SEQ ID NO: 9858 - protein, 126 aa, Artificial Sequence
  Description of Artificial Sequence: Synthetic polypeptide
EVQLLESGPGLVKPSQTLSLTCTVSGDSISSNPYYWSWIRQHPGKGLEWIGYISHSGSTYYNPSLKSRVTISVDTSKNQFSLNLTSVTAADTAVYYCAREKMWFGVLNYYYGMDVWGLGTTVTVSS

SEQ ID NO: 9859 - DNA, 255 bp, Artificial Sequence; identical to SEQ ID NO: 6995
  Description of Artificial Sequence: Synthetic polynucleotide

SEQ ID NO: 9860 - protein, 126 aa, Artificial Sequence
  Description of Artificial Sequence: Synthetic polypeptide
EVQLLESGPGLVKPSQTLSLTCTVSGDSISSNPYYWSWIRQHPGKGLEWIGYISHSGSTYYNPSLKSRVTISVDTSKNQFSLKLTSVTAADTAVYYCARDRLWFGVLNYYYGMDVWGLGTTVTVSS

SEQ ID NO: 9861 - DNA, 255 bp, Artificial Sequence; identical to SEQ ID NO: 6997
  Description of Artificial Sequence: Synthetic polynucleotide

SEQ ID NO: 9862 - protein, 127 aa, Artificial Sequence; identical to SEQ ID NO: 9850
  Description of Artificial Sequence: Synthetic polypeptide

SEQ ID NO: 9863 - DNA, 255 bp, Artificial Sequence; identical to SEQ ID NO: 6997
  Description of Artificial Sequence: Synthetic polynucleotide

SEQ ID NO: 9864 - protein, 127 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSYSGSYYNYFSVMDVWGQGTTVTVSS

SEQ ID NO: 9865 - DNA, 255 bp, Artificial Sequence; identical to SEQ ID NO: 7001
  Description of Artificial Sequence: Synthetic polynucleotide

SEQ ID NO: 9866 - protein, 127 aa, Artificial Sequence; identical to SEQ ID NO: 9852
  Description of Artificial Sequence: Synthetic polypeptide

SEQ ID NO: 9867 - DNA, 255 bp, Artificial Sequence; identical to SEQ ID NO: 7003
  Description of Artificial Sequence: Synthetic polynucleotide

SEQ ID NO: 9868 - protein, 124 aa, Artificial Sequence
  Description of Artificial Sequence: Synthetic polypeptide
EVQLLESGPGLVKPSETLTLTCTVSGGSISSYYWSWIRQPAGKGLEWIGHIYTSGSTNYNPSLKSRVTMSVDSSKNQFSLKLTSLTAADTAVYYCAREKMWFGVLNYYYGMDVWGQGTTVTVSS

SEQ ID NO: 9869 - DNA, 255 bp, Artificial Sequence; identical to SEQ ID NO: 6977
  Description of Artificial Sequence: Synthetic polynucleotide

SEQ ID NO: 9870 - protein, 126 aa, Artificial Sequence; identical to SEQ ID NO: 9842
  Description of Artificial Sequence: Synthetic polypeptide

SEQ ID NO: 9871 - DNA, 255 bp, Artificial Sequence; identical to SEQ ID NO: 6983
  Description of Artificial Sequence: Synthetic polynucleotide

SEQ ID NO: 9872 - protein, 126 aa, Artificial Sequence; identical to SEQ ID NO: 9848
  Description of Artificial Sequence: Synthetic polypeptide

SEQ ID NO: 9873 - DNA, 255 bp, Artificial Sequence; identical to SEQ ID NO: 7009
  Description of Artificial Sequence: Synthetic polynucleotide

SEQ ID NO: 9874 - protein, 124 aa, Artificial Sequence
  Description of Artificial Sequence: Synthetic polypeptide
EVQLLESGPGLVKPTETLSLTCTVSGGSISDFFWSWIRQPPGKGLEWIGYIYYRGSTNYHPSLKSRVTMSVDTSKNQFSLKLTSLTAADTAVYYCAREKMWFGVLNYYYGMDVWGQGTTVTVSS

SEQ ID NO: 9875 - DNA, 255 bp, Artificial Sequence; identical to SEQ ID NO: 6983
  Description of Artificial Sequence: Synthetic polynucleotide

SEQ ID NO: 9876 - protein, 126 aa, Artificial Sequence; identical to SEQ ID NO: 9848
  Description of Artificial Sequence: Synthetic polypeptide

SEQ ID NO: 9877 - DNA, 255 bp, Artificial Sequence; identical to SEQ ID NO: 7013
  Description of Artificial Sequence: Synthetic polynucleotide

SEQ ID NO: 9878 - protein, 126 aa, Artificial Sequence
  Description of Artificial Sequence: Synthetic polypeptide
EVQLLESGPGLVKPSQTLSLTCTVSGDSISSNPYYWSWIRQHPGMGLEWIGYIYYSGSTSYNPSLKSRVTMSVDSSKNQFSLKLTSVTAADTAVYYCARDLLWFGKLNYYYGLDVWGQGTTVTVSS

SEQ ID NO: 9879 - DNA, 255 bp, Artificial Sequence; identical to SEQ ID NO: 7015
  Description of Artificial Sequence: Synthetic polynucleotide

SEQ ID NO: 9880 - protein, 126 aa, Artificial Sequence
  Description of Artificial Sequence: Synthetic polypeptide
EVQLLESGPGLVKPSQTLSLTCTVSGGAISSGDYYWSWIRQHPGKGLEWIGYIDKSGSTYYNPSLKSRATISVDTSKNQFSLKLSSVTAADTAVYYCARDLLWFGKLNYYYGLDVWGQGTTVTVSS

SEQ ID NO: 9881 - DNA, 255 bp, Artificial Sequence; identical to SEQ ID NO: 7017
  Description of Artificial Sequence: Synthetic polynucleotide

SEQ ID NO: 9882 - protein, 126 aa, Artificial Sequence
  Description of Artificial Sequence: Synthetic polypeptide
EVQLLESGPGLVKPSQTLSLTCTVSGGSISSNPYYWSWIRQHPGKGLEWIGYISHSGSTYYNPSLKSRVTISVDTSKNQFSLNLTSVTAADTAVYYCAREKMWFGVLNYYYGMDVWGQGTTVTVSS

SEQ ID NO: 9883 - DNA, 255 bp, Artificial Sequence; identical to SEQ ID NO: 7019
  Description of Artificial Sequence: Synthetic polynucleotide

SEQ ID NO: 9884 - protein, 126 aa, Artificial Sequence
  Description of Artificial Sequence: Synthetic polypeptide
EVQLLESGPGLVKPSQTLSLTCTVSGDSISSNPYYWSWIRQHPGKGLEWIGYISYSGSTYYNPSLKSRVTISVDTSKNQFSLNLTSVTAADTAVYYCARDRLWFGVLNYYYGMDVWGPGTTVTVSS

SEQ ID NO: 9885 - DNA, 255 bp, Artificial Sequence; identical to SEQ ID NO: 7019
  Description of Artificial Sequence: Synthetic polynucleotide

SEQ ID NO: 9886 - protein, 126 aa, Artificial Sequence; identical to SEQ ID NO: 9884
  Description of Artificial Sequence: Synthetic polypeptide

SEQ ID NO: 9887 - DNA, 255 bp, Artificial Sequence; identical to SEQ ID NO: 6985
  Description of Artificial Sequence: Synthetic polynucleotide

SEQ ID NO: 9888 - protein, 127 aa, Artificial Sequence
  Description of Artificial Sequence: Synthetic polypeptide
EVQLLESGGGLVKPGGSLRLSCAASGFTFSNAWMSWVRQAPGKGLEWVGRIKGNTYGGTTDYAAPVKGRFTISRDDSKNTLFLQMNSLKTEDTAVYYCTTPSNGGSYYNYFSVMDVWGQGTTVTVSS

SEQ ID NO: 9889 - DNA, 255 bp, Artificial Sequence; identical to SEQ ID NO: 7025
  Description of Artificial Sequence: Synthetic polynucleotide

SEQ ID NO: 9890 - protein, 124 aa, Artificial Sequence
  Description of Artificial Sequence: Synthetic polypeptide
EVQLLESGPGLVKPSETLSLTCTVSGGSISNYYWSWVRQPAGKGLEWIGHIYTSGSTNFNPSLKSRVTMSVDTSKNQFSLKLTSLTAADTAVYYCAREKMWFGVLNYYYGMDVWGQGTTVTVSS

SEQ ID NO: 9891 - DNA, 255 bp, Artificial Sequence; identical to SEQ ID NO: 7027
  Description of Artificial Sequence: Synthetic polynucleotide

SEQ ID NO: 9892 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCATGKGVHLGFDYWGQGTLVTVSS

SEQ ID NO: 9893 - DNA, 255 bp, Artificial Sequence; identical to SEQ ID NO: 7029
  Description of Artificial Sequence: Synthetic polynucleotide

SEQ ID NO: 9894 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYYADSVKGRFTISRDNSKNTLYLQMNSLRAEDTAVYYCATGKGVHLNFDYWGQGTLVTVSS

SEQ ID NO: 9895 - DNA, 255 bp, Artificial Sequence; identical to SEQ ID NO: 7031
  Description of Artificial Sequence: Synthetic polynucleotide

SEQ ID NO: 9896 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSTISGSGGGTYYADSVKGRFTISRDNSKNTLYLQMNSLRAEDTAVYYCATGKGVHLGFDYWGQGTLVTVSS

SEQ ID NO: 9897 - DNA, 255 bp, Artificial Sequence; identical to SEQ ID NO: 7033
  Description of Artificial Sequence: Synthetic polynucleotide

SEQ ID NO: 9898 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLGFDYWGQGTLVTVSS

SEQ ID NO: 9899 - DNA, 255 bp, Artificial Sequence; identical to SEQ ID NO: 7035
  Description of Artificial Sequence: Synthetic polynucleotide

SEQ ID NO: 9900 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAAYYCVTGKGVHLGFDYWGQGTLVTVSS

SEQ ID NO: 9901 - DNA, 255 bp, Artificial Sequence; identical to SEQ ID NO: 7037
  Description of Artificial Sequence: Synthetic polynucleotide

SEQ ID NO: 9902 - protein, 119 aa, Artificial Sequence; identical to SEQ ID NO: 9898
  Description of Artificial Sequence: Synthetic polypeptide

SEQ ID NO: 9903 - DNA, 255 bp, Artificial Sequence; identical to SEQ ID NO: 7039
  Description of Artificial Sequence: Synthetic polynucleotide

SEQ ID NO: 9904 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAVYYCATGKGVHLGFDYWGQGTLVTVSS

SEQ ID NO: 9905 - DNA, 255 bp, Artificial Sequence; identical to SEQ ID NO: 7041
  Description of Artificial Sequence: Synthetic polynucleotide

SEQ ID NO: 9906 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKARFTISRDNSKNTLYLQMNSLRAEDTAVYYCATGKGVHLGFDYWGQGTLVTVSS

SEQ ID NO: 9907 - DNA, 255 bp, Artificial Sequence; identical to SEQ ID NO: 7043
  Description of Artificial Sequence: Synthetic polynucleotide

SEQ ID NO: 9908 - protein, 119 aa, Artificial Sequence; identical to SEQ ID NO: 9898
  Description of Artificial Sequence: Synthetic polypeptide

SEQ ID NO: 9909 - DNA, 255 bp, Artificial Sequence; identical to SEQ ID NO: 7045
  Description of Artificial Sequence: Synthetic polynucleotide

SEQ ID NO: 9910 - protein, 119 aa, Artificial Sequence
  Description of Artificial Sequence: Synthetic polypeptide
EVQLLESGGGLVQPGGSLRLSCAASGFTFSSYAMSWVRQAPGQGLEWVSAISGSGGGTYYADSVKGRFTISRDNSKNTLYLQMNSLRAEDTAVYYCATGKGVHLGFDHWGQGTLVTVSS

SEQ ID NO: 9911 - DNA, 255 bp, Artificial Sequence; identical to SEQ ID NO: 7047
  Description of Artificial Sequence: Synthetic polynucleotide

SEQ ID NO: 9912 - protein, 119 aa, Artificial Sequence
  Description of Artificial Sequence: Synthetic polypeptide
EVQLLESGGGLVQPGGSLRLSCAASGFTFSSYAMNWVRQAPGKGLEWVSAISGSGGGTYYADSVKGRFTISRDNSKNTLYLQMNSLRAEDTAVYYCATGKGVHLNFDYWGQGTLVTVSS

SEQ ID NO: 9913 - DNA, 255 bp, Artificial Sequence; identical to SEQ ID NO: 7037
  Description of Artificial Sequence: Synthetic polynucleotide

SEQ ID NO: 9914 - protein, 119 aa, Artificial Sequence; identical to SEQ ID NO: 9898
  Description of Artificial Sequence: Synthetic polypeptide

SEQ ID NO: 9915 - DNA, 255 bp, Artificial Sequence; identical to SEQ ID NO: 7051
  Description of Artificial Sequence: Synthetic polynucleotide

SEQ ID NO: 9916 - protein, 119 aa, Artificial Sequence
  Description of Artificial Sequence: Synthetic polypeptide
EVQLLESGGDLVQPGGSLRLSCAASGFTFSSHAMSWVRQAPGKGLEWVSAISGSGGGTYYADSVKGRFTISRDNSKNTLYLQMNSLRAEDTAVYYCATGKGVHLGFDYWGQGTLVTVSS

SEQ ID NO: 9917 - DNA, 255 bp, Artificial Sequence; identical to SEQ ID NO: 7037
  Description of Artificial Sequence: Synthetic polynucleotide

SEQ ID NO: 9918 - protein, 119 aa, Artificial Sequence; identical to SEQ ID NO: 9898
  Description of Artificial Sequence: Synthetic polypeptide

SEQ ID NO: 9919 - DNA, 255 bp, Artificial Sequence; identical to SEQ ID NO: 7055
  Description of Artificial Sequence: Synthetic polynucleotide

SEQ ID NO: 9920 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSTISGSGGGTYYADSVKGRFTISRDNSKNTLYLQMNSLRAEDTAVYYCATGKGVHLNFDYWGQGTLVTVSS

SEQ ID NO: 9921 - DNA, 255 bp, Artificial Sequence; identical to SEQ ID NO: 7031
  Description of Artificial Sequence: Synthetic polynucleotide

SEQ ID NO: 9922 - protein, 119 aa, Artificial Sequence; identical to SEQ ID NO: 9896
  Description of Artificial Sequence: Synthetic polypeptide

SEQ ID NO: 9923 - DNA, 255 bp, Artificial Sequence; identical to SEQ ID NO: 7059
  Description of Artificial Sequence: Synthetic polynucleotide

SEQ ID NO: 9924 - protein, 119 aa, Artificial Sequence
  Description of Artificial Sequence: Synthetic polypeptide
EVQLLESGGDLVQPGGSLRLSCAASGITFSSYAMSWVRQAPGKGLEWVSAISGSGGGTYYADSGKGRFTISRDNSKNTLYLQMNSLRAEDTAVYYCATGKGVHLGFDYWGQGTLVTVSS

SEQ ID NO: 9925 - DNA, 255 bp, Artificial Sequence; identical to SEQ ID NO: 7061
  Description of Artificial Sequence: Synthetic polynucleotide

SEQ ID NO: 9926 - protein, 119 aa, Artificial Sequence
  Description of Artificial Sequence: Synthetic polypeptide
EVQLLESGGDLVQPGGSLRLSCAASGFTFSSYAMSWVRQAPGKGLEWVSTISGSGGGTYYADSVKGRFTISRDNSKNTLYLQMNSLRAEDTAVYYCAPGKGVHLNFDYWGQGTLVTVSS

SEQ ID NO: 9927 - DNA, 255 bp, Artificial Sequence; identical to SEQ ID NO: 7037
  Description of Artificial Sequence: Synthetic polynucleotide

SEQ ID NO: 9928 - protein, 119 aa, Artificial Sequence; identical to SEQ ID NO: 9898
  Description of Artificial Sequence: Synthetic polypeptide

SEQ ID NO: 9929 - DNA, 255 bp, Artificial Sequence; identical to SEQ ID NO: 7065
  Description of Artificial Sequence: Synthetic polynucleotide

SEQ ID NO: 9930 - protein, 119 aa, Artificial Sequence
  Description of Artificial Sequence: Synthetic polypeptide
EVQLLESGGDLVQPGGSLRLSCAASGFTFSSYAMSWVRQAPGKGLEWVSTISGSGGGTYYADSVKGRFTISRDNSKNTLYLQMNSLRAEDTAVYYCATGKGVHLNFDYWGQGTLVTVSS

SEQ ID NO: 9931 - DNA, 255 bp, Artificial Sequence; identical to SEQ ID NO: 7067
  Description of Artificial Sequence: Synthetic polynucleotide

SEQ ID NO: 9932 - protein, 119 aa, Artificial Sequence; identical to SEQ ID NO: 9912
  Description of Artificial Sequence: Synthetic polypeptide

SEQ ID NO: 9933 - DNA, 255 bp, Artificial Sequence; identical to SEQ ID NO: 7069
  Description of Artificial Sequence: Synthetic polynucleotide

SEQ ID NO: 9934 - protein, 119 aa, Artificial Sequence
  Description of Artificial Sequence: Synthetic polypeptide
EVQLLESGGDLVQPGGSLRLSCAASGFTFGSYAMSWVRQAPGKGLEWVSAISGSGGGTYYADSVKGRFTISRDNSKNTLYLQMNSLRAEDTAVYYCATGKGVHLGFDYWGQGTLVTVSS

SEQ ID NO: 9935 - DNA, 255 bp, Artificial Sequence; identical to SEQ ID NO: 7043
  Description of Artificial Sequence: Synthetic polynucleotide

SEQ ID NO: 9936 - protein, 119 aa, Artificial Sequence; identical to SEQ ID NO: 9898
  Description of Artificial Sequence: Synthetic polypeptide

SEQ ID NO: 9937 - DNA, 255 bp, Artificial Sequence; identical to SEQ ID NO: 7073
  Description of Artificial Sequence: Synthetic polynucleotide

SEQ ID NO: 9938 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMSSLRAEDTAVYYCATGKGVHLGFDYWGQGTLVTVSS

SEQ ID NO: 9939 - DNA, 255 bp, Artificial Sequence; identical to SEQ ID NO: 7075
  Description of Artificial Sequence: Synthetic polynucleotide

SEQ ID NO: 9940 - protein, 119 aa, Artificial Sequence; identical to SEQ ID NO: 9906
  Description of Artificial Sequence: Synthetic polypeptide

SEQ ID NO: 9941 - DNA, 255 bp, Artificial Sequence; identical to SEQ ID NO: 7077
  Description of Artificial Sequence: Synthetic polynucleotide

SEQ ID NO: 9942 - protein, 119 aa, Artificial Sequence
  Description of Artificial Sequence: Synthetic polypeptide
EVQLLESGGDLVQPGGSLRLSCAASGFTFSSYAMSWVRQAPGKGLEWVSAISGSGGGTYYADSVKGRFTISRDNSKNTLYLQMNSLRAEDTAVYYCATGKGVHLNFDYWGQGTLVTVSS

SEQ ID NO: 9943 - DNA, 255 bp, Artificial Sequence; identical to SEQ ID NO: 7079
  Description of Artificial Sequence: Synthetic polynucleotide

SEQ ID NO: 9944 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAVYYCATGKGVHLNFDYWGQGTLVTVSS

SEQ ID NO: 9945 - DNA, 255 bp, Artificial Sequence; identical to SEQ ID NO: 7081
  Description of Artificial Sequence: Synthetic polynucleotide

SEQ ID NO: 9946 - protein, 119 aa, Artificial Sequence; identical to SEQ ID NO: 9896
  Description of Artificial Sequence: Synthetic polypeptide

SEQ ID NO: 9947 - DNA, 255 bp, Artificial Sequence; identical to SEQ ID NO: 7083
  Description of Artificial Sequence: Synthetic polynucleotide

SEQ ID NO: 9948 - protein, 119 aa, Artificial Sequence
  Description of Artificial Sequence: Synthetic polypeptide
EVQLLESGGDLVQPGGSLRLSCAASGFTFSSYAMHWVRQAPGQGLEWVSAISGSGGGTYYADSVKGRFTISRDNSKNTLYLQMNSLRAEDTAVYYCATGKGVHLGFDYWGQGTLVTVSS

SEQ ID NO: 9949 - DNA, 255 bp, Artificial Sequence; identical to SEQ ID NO: 7085
  Description of Artificial Sequence: Synthetic polynucleotide

SEQ ID NO: 9950 - protein, 119 aa, Artificial Sequence
  Description of Artificial Sequence: Synthetic polypeptide
EVQLLESGGGLVQPGGSLRLSCAASGFTFSSYAMTWVRQAPGKGLEWVSAISGSGGGTYYADSVKGRFTISRDNSKNTLYLQMSSLRAEDTAVYYCATGKGVHLGFDYWGQGTLVTVSS

SEQ ID NO: 9951 - DNA, 255 bp, Artificial Sequence; identical to SEQ ID NO: 7087
  Description of Artificial Sequence: Synthetic polynucleotide

SEQ ID NO: 9952 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYNADSVKGRFTISRDNSKNTLYLQMNSLRAEDTAAYYCVTGKGVHLGFDYWGQGTLVTVSS

SEQ ID NO: 9953 - DNA, 255 bp, Artificial Sequence; identical to SEQ ID NO: 7089
  Description of Artificial Sequence: Synthetic polynucleotide

SEQ ID NO: 9954 - protein, 119 aa, Artificial Sequence; identical to SEQ ID NO: 9898
  Description of Artificial Sequence: Synthetic polypeptide

SEQ ID NO: 9955 - DNA, 255 bp, Artificial Sequence; identical to SEQ ID NO: 7091
  Description of Artificial Sequence: Synthetic polynucleotide

SEQ ID NO: 9956 - protein, 119 aa, Artificial Sequence; identical to SEQ ID NO: 9906
  Description of Artificial Sequence: Synthetic polypeptide

SEQ ID NO: 9957 - DNA, 255 bp, Artificial Sequence; identical to SEQ ID NO: 7035
  Description of Artificial Sequence: Synthetic polynucleotide

SEQ ID NO: 9958 - protein, 119 aa, Artificial Sequence; identical to SEQ ID NO: 9900
  Description of Artificial Sequence: Synthetic polypeptide

SEQ ID NO: 9959 - DNA, 255 bp, Artificial Sequence; identical to SEQ ID NO: 7095
  Description of Artificial Sequence: Synthetic polynucleotide

SEQ ID NO: 9960 - protein, 116 aa, Artificial Sequence
  Description of Artificial Sequence: Synthetic polypeptide
EVQLLESGGGVVQPGRSLRLSCAASGFTFSTYGMHWVRQAPGKGLEWVAVISYDGSNKYYADSVKGRFTISRDDSKNTLYLQMNSLRAEDTAVYYCARGQLLTGYWGQGTLVTVSS

SEQ ID NO: 9961 - DNA, 255 bp, Artificial Sequence; identical to SEQ ID NO: 7097
  Description of Artificial Sequence: Synthetic polynucleotide

SEQ ID NO: 9962 - protein, 116 aa, Artificial Sequence
  Description of Artificial Sequence: Synthetic polypeptide
EVQLLESGAEVKKPGASVKVSCKASGYTFTRNGLSWVRQAPGQGLEWMGWISGYNGDTNYAQKLQGRGTMTTDTSTSTAYMELRSLRSDDTAVYYCARGRATFDYWGQGTLVTVSS

SEQ ID NO: 9963 - DNA, 255 bp, Artificial Sequence; identical to SEQ ID NO: 7097
  Description of Artificial Sequence: Synthetic polynucleotide

SEQ ID NO: 9964 - protein, 116 aa, Artificial Sequence; identical to SEQ ID NO: 9962
  Description of Artificial Sequence: Synthetic polypeptide

SEQ ID NO: 9965 - DNA, 255 bp, Artificial Sequence; identical to SEQ ID NO: 7101
  Description of Artificial Sequence: Synthetic polynucleotide

SEQ ID NO: 9966 - protein, 117 aa, Artificial Sequence
  Description of Artificial Sequence: Synthetic polypeptide
EVQLLESGGGLVKPGGSLRLSCAASGFTFSDYYMSWIRQAPGKGLEWVSYISKSGSTIYYADSVKGRFTISRDNAKNSLYLQMNSLRAEDTAVYYCATYNYGHFDYWGQGTLVTVSS

SEQ ID NO: 9967 - DNA, 255 bp, Artificial Sequence; identical to SEQ ID NO: 7103
  Description of Artificial Sequence: Synthetic polynucleotide

SEQ ID NO: 9968 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYYADSVKGRFTISRDNSKNTLYLQMNSLRAEDTAVYYCATGKGVHLGFDYWGQGTLVTVSS

SEQ ID NO: 9969 - DNA, 255 bp, Artificial Sequence; identical to SEQ ID NO: 7105
  Description of Artificial Sequence: Synthetic polynucleotide

SEQ ID NO: 9970 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYYADSVKARFTISRDNSKNTLYLQMNSLRAEDTAVYYCATGKGVHLGFDYWGQGTLVTVSS

SEQ ID NO: 9971 - DNA, 255 bp, Artificial Sequence; identical to SEQ ID NO: 7107
  Description of Artificial Sequence: Synthetic polynucleotide

SEQ ID NO: 9972 - protein, 119 aa, Artificial Sequence; identical to SEQ ID NO: 9944
  Description of Artificial Sequence: Synthetic polypeptide

SEQ ID NO: 9973 - DNA, 255 bp, Artificial Sequence; identical to SEQ ID NO: 7109
  Description of Artificial Sequence: Synthetic polynucleotide

SEQ ID NO: 9974 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMNSLRAEDTAAYYCVTGKGVHLGFDYWGQGTLVTVSS

SEQ ID NO: 9975 - DNA, 255 bp, Artificial Sequence; identical to SEQ ID NO: 7035
  Description of Artificial Sequence: Synthetic polynucleotide

SEQ ID NO: 9976 - protein, 119 aa, Artificial Sequence; identical to SEQ ID NO: 9900
  Description of Artificial Sequence: Synthetic polypeptide

SEQ ID NO: 9977 - DNA, 255 bp, Artificial Sequence; identical to SEQ ID NO: 7113
  Description of Artificial Sequence: Synthetic polynucleotide

SEQ ID NO: 9978 - protein, 119 aa, Artificial Sequence; identical to SEQ ID NO: 9896
  Description of Artificial Sequence: Synthetic polypeptide

SEQ ID NO: 9979 - DNA, 255 bp, Artificial Sequence; identical to SEQ ID NO: 7115
  Description of Artificial Sequence: Synthetic polynucleotide

SEQ ID NO: 9980 - protein, 119 aa, Artificial Sequence
  Description of Artificial Sequence: Synthetic polypeptide
EVQLLESGGGLVKPGGSLRLSCAASGFTFSSYAMNWVRQAPGKGLEWVSAISGSGGGTYYADSGKGRFTISRDNSKNTLYLQMNSLRAEDTAVYYCATGKGVHLNFDYWGQGTLVTVSS

SEQ ID NO: 9981 - DNA, 255 bp, Artificial Sequence; identical to SEQ ID NO: 7117
  Description of Artificial Sequence: Synthetic polynucleotide

SEQ ID NO: 9982 - protein, 119 aa, Artificial Sequence
  Description of Artificial Sequence: Synthetic polypeptide
EVQLLESGGGLVQPGGSLRLSCAASGFTFSSHAMSWVRQAPGQGLEWVSSISGSGGGTYYAASVKGRFTISRDNSKNTLYLQMNSLRAEDTAVYYCATGKGVHLNFDYWGQGTLVTVSS

SEQ ID NO: 9983 - DNA, 255 bp, Artificial Sequence; identical to SEQ ID NO: 7119
  Description of Artificial Sequence: Synthetic polynucleotide

SEQ ID NO: 9984 - protein, 119 aa, Artificial Sequence; identical to SEQ ID NO: 9938
  Description of Artificial Sequence: Synthetic polypeptide

SEQ ID NO: 9985 - DNA, 255 bp, Artificial Sequence; identical to SEQ ID NO: 7031
  Description of Artificial Sequence: Synthetic polynucleotide

SEQ ID NO: 9986 - protein, 119 aa, Artificial Sequence; identical to SEQ ID NO: 9896
  Description of Artificial Sequence: Synthetic polypeptide

SEQ ID NO: 9987 - DNA, 255 bp, Artificial Sequence; identical to SEQ ID NO: 7123
  Description of Artificial Sequence: Synthetic polynucleotide

SEQ ID NO: 9988 - protein, 119 aa, Artificial Sequence
  Description of Artificial Sequence: Synthetic polypeptide
EVQLLESGGGVVQPGRSLRLSCAASGFTFSSYAMTWVRQAPGQGLEWVSSISGSGGGTYYAASVKGRFTISRDNSKNTLYLQMNSLRAEDTAVYYCATGKGVHLGFDYWGQGTLVTVSS

SEQ ID NO: 9989 - DNA, 255 bp, Artificial Sequence; identical to SEQ ID NO: 7039
  Description of Artificial Sequence: Synthetic polynucleotide

SEQ ID NO: 9990 - protein, 119 aa, Artificial Sequence; identical to SEQ ID NO: 9900
  Description of Artificial Sequence: Synthetic polypeptide

SEQ ID NO: 9991 - DNA, 255 bp, Artificial Sequence; identical to SEQ ID NO: 7127
  Description of Artificial Sequence: Synthetic polynucleotide

SEQ ID NO: 9992 - protein, 121 aa, Artificial Sequence; identical to SEQ ID NO: 9804
  Description of Artificial Sequence: Synthetic polypeptide

SEQ ID NO: 9993 - DNA, 255 bp, Artificial Sequence; identical to SEQ ID NO: 7127
  Description of Artificial Sequence: Synthetic polynucleotide

SEQ ID NO: 9994 - protein, 121 aa, Artificial Sequence; identical to SEQ ID NO: 9804
  Description of Artificial Sequence: Synthetic polypeptide

SEQ ID NO: 9995 - DNA, 255 bp, Artificial Sequence; identical to SEQ ID NO: 7131
  Description of Artificial Sequence: Synthetic polynucleotide

SEQ ID NO: 9996 - protein, 123 aa, Artificial Sequence
  Description of Artificial Sequence: Synthetic polypeptide
EVQLLESGPVLVKPTQTLTLTCTFSGFSFTTHKMGVDWIRQPPGKALEWLALIYWNDDKRYNPSLQSRLTITKDTSKNQVVLTMTNMDPVDTATYYCAYRRYNWNYENWFDPWGQGTLVTVSS

SEQ ID NO: 9997 - DNA, 255 bp, Artificial Sequence; identical to SEQ ID NO: 7133
  Description of Artificial Sequence: Synthetic polynucleotide

SEQ ID NO: 9998 - protein, 123 aa, Artificial Sequence
  Description of Artificial Sequence: Synthetic polypeptide
EVQLLESGPTLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSS

SEQ ID NO: 9999 - DNA, 255 bp, Artificial Sequence; identical to SEQ ID NO: 7135
  Description of Artificial Sequence: Synthetic polynucleotide

SEQ ID NO: 10000 - protein, 123 aa, Artificial Sequence
  Description of Artificial Sequence: Synthetic polypeptide
EVQLLESGPMLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSS

SEQ ID NO: 10001 - DNA, 255 bp, Artificial Sequence; identical to SEQ ID NO: 7135
  Description of Artificial Sequence: Synthetic polynucleotide

SEQ ID NO: 10002 - protein, 123 aa, Artificial Sequence; identical to SEQ ID NO: 10000
  Description of Artificial Sequence: Synthetic polypeptide

SEQ ID NO: 10003 - DNA, 255 bp, Artificial Sequence; identical to SEQ ID NO: 7139
  Description of Artificial Sequence: Synthetic polynucleotide

SEQ ID NO: 10004 - protein, 123 aa, Artificial Sequence
  Description of Artificial Sequence: Synthetic polypeptide
EVQLLESGPALVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSS

SEQ ID NO: 10005 - DNA, 255 bp, Artificial Sequence; identical to SEQ ID NO: 7135
  Description of Artificial Sequence: Synthetic polynucleotide

SEQ ID NO: 10006 - protein, 123 aa, Artificial Sequence; identical to SEQ ID NO: 10000
  Description of Artificial Sequence: Synthetic polypeptide

SEQ ID NO: 10007 - DNA, 255 bp, Artificial Sequence; identical to SEQ ID NO: 7143
  Description of Artificial Sequence: Synthetic polynucleotide

SEQ ID NO: 10008 - protein, 126 aa, Artificial Sequence
  Description of Artificial Sequence: Synthetic polypeptide
EVQLLESGGGLVQPGGSLRLSCAASGFTFSSYAMSWVRQAPGRGLEWVSTISISGGSTNYADSVKGRFTISRDNSKNTLYLQMNSLRAEDTAVYYCAKDGGSGWFPKLLHYGLDVWGQGTTVTVSS

SEQ ID NO: 10009 - DNA, 255 bp, Artificial Sequence; identical to SEQ ID NO: 7145
  Description of Artificial Sequence: Synthetic polynucleotide

SEQ ID NO: 10010 - protein, 127 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLYLQMNSLKTEDTAVYYCTTPSYSGSYYNYFSVMDVWGQGTTVTVSS

SEQ ID NO: 10011 - DNA, 255 bp, Artificial Sequence; identical to SEQ ID NO: 7147
  Description of Artificial Sequence: Synthetic polynucleotide

SEQ ID NO: 10012 - protein, 127 aa, Artificial Sequence
  Description of Artificial Sequence: Synthetic polypeptide
EVQLLESGGGLVQPGGSLRLSCAASGFTFSNAWMSWVRQAPGKGLEWVGRIKSKTYGGTTDYAAPVKGRFTISRDDSKNTLYLQMNSLKTEDTAVYYCTTPSYSGSYYNYFSVMDVWGQGTTVTVSS

SEQ ID NO: 10013 - DNA, 255 bp, Artificial Sequence; identical to SEQ ID NO: 7149
  Description of Artificial Sequence: Synthetic polynucleotide

SEQ ID NO: 10014 - protein, 127 aa, Artificial Sequence; identical to SEQ ID NO: 9852
  Description of Artificial Sequence: Synthetic polypeptide

SEQ ID NO: 10015 - DNA, 255 bp, Artificial Sequence; identical to SEQ ID NO: 6997
  Description of Artificial Sequence: Synthetic polynucleotide

SEQ ID NO: 10016 - protein, 127 aa, Artificial Sequence; identical to SEQ ID NO: 9864
  Description of Artificial Sequence: Synthetic polypeptide

SEQ ID NO: 10017 - DNA, 255 bp, Artificial Sequence; identical to SEQ ID NO: 6987
  Description of Artificial Sequence: Synthetic polynucleotide

SEQ ID NO: 10018 - protein, 127 aa, Artificial Sequence
  Description of Artificial Sequence: Synthetic polypeptide
EVQLLESGGGLVQPGGSLRLSCAASGFTFSNAWMSWVRQAPGKGLEWVGRIKGNTYGGTTDYAAPVKGRFTISRDDSKNTLFLQMNSLKTEDTAVYYCTTPSYSGSYYNYFSVMDVWGQGTTVTVSS

SEQ ID NO: 10019 - DNA, 255 bp, Artificial Sequence; identical to SEQ ID NO: 6997
  Description of Artificial Sequence: Synthetic polynucleotide

SEQ ID NO: 10020 - protein, 127 aa, Artificial Sequence; identical to SEQ ID NO: 9864
  Description of Artificial Sequence: Synthetic polypeptide

SEQ ID NO: 10021 - DNA, 255 bp, Artificial Sequence; identical to SEQ ID NO: 7157
  Description of Artificial Sequence: Synthetic polynucleotide

SEQ ID NO: 10022 - protein, 126 aa, Artificial Sequence
  Description of Artificial Sequence: Synthetic polypeptide
EVQLLESGPGLVKPSQTLSLTCTVSGDSISSNPYYWSWIRQHPGKGLEWIGYISYSGITNYNPSLKSRVTMSVDTSKNQFSLKLTSLTAADTAVYYCAREKMWFGVLNYYYGMDVWGQGTTVTVSS

SEQ ID NO: 10023 - DNA, 255 bp, Artificial Sequence; identical to SEQ ID NO: 6977
  Description of Artificial Sequence: Synthetic polynucleotide

SEQ ID NO: 10024 - protein, 126 aa, Artificial Sequence; identical to SEQ ID NO: 9842
  Description of Artificial Sequence: Synthetic polypeptide

SEQ ID NO: 10025 - DNA, 255 bp, Artificial Sequence; identical to SEQ ID NO: 6987
  Description of Artificial Sequence: Synthetic polynucleotide

SEQ ID NO: 10026 - protein, 127 aa, Artificial Sequence; identical to SEQ ID NO: 9852
  Description of Artificial Sequence: Synthetic polypeptide

SEQ ID NO: 10027 - DNA, 255 bp, Artificial Sequence; identical to SEQ ID NO: 7163
  Description of Artificial Sequence: Synthetic polynucleotide

SEQ ID NO: 10028 - protein, 127 aa, Artificial Sequence; identical to SEQ ID NO: 10018
  Description of Artificial Sequence: Synthetic polypeptide

SEQ ID NO: 10029 - DNA, 255 bp, Artificial Sequence; identical to SEQ ID NO: 6985
  Description of Artificial Sequence: Synthetic polynucleotide

SEQ ID NO: 10030 - protein, 127 aa, Artificial Sequence; identical to SEQ ID NO: 9864
  Description of Artificial Sequence: Synthetic polypeptide

SEQ ID NO: 10031 - DNA, 255 bp, Artificial Sequence; identical to SEQ ID NO: 6993
  Description of Artificial Sequence: Synthetic polynucleotide

SEQ ID NO: 10032 - protein, 126 aa, Artificial Sequence
  Description of Artificial Sequence: Synthetic polypeptide
EVQLLESGPGLVKPSQTLSLTCTVSGDSISSNPYYWSWIRQHPGKGLEWIGYISHSGSTYYNPSLKSRVTISVDTSKNQFSLNLTSVTAADTAVYYCARDRLWFGVLNYYYGMDVWGLGTTVTVSS

SEQ ID NO: 10033 - DNA, 255 bp, Artificial Sequence; identical to SEQ ID NO: 6977
  Description of Artificial Sequence: Synthetic polynucleotide

SEQ ID NO: 10034 - protein, 126 aa, Artificial Sequence; identical to SEQ ID NO: 9842
  Description of Artificial Sequence: Synthetic polypeptide

SEQ ID NO: 10035 - DNA, 255 bp, Artificial Sequence; identical to SEQ ID NO: 7171
  Description of Artificial Sequence: Synthetic polynucleotide

SEQ ID NO: 10036 - protein, 126 aa, Artificial Sequence
  Description of Artificial Sequence: Synthetic polypeptide
EVQLLESGPGLVKPSQTLSLTCTVSGGSISSGGYYWSWIRQHPGKGLEWIGYISHSGSTYYNPSLKSRVTISVDTSKNQFSLNLTSVTAADTAVYYCAREKMWFGVLNYYYGMDVWGQGTTVTVSS

SEQ ID NO: 10037 - DNA, 255 bp, Artificial Sequence; identical to SEQ ID NO: 7145
  Description of Artificial Sequence: Synthetic polynucleotide

SEQ ID NO: 10038 - protein, 127 aa, Artificial Sequence; identical to SEQ ID NO: 10010
  Description of Artificial Sequence: Synthetic polypeptide

SEQ ID NO: 10039 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYAASVKGRFTISRDNSKNTLYLQMSSLRAEDTAVYYCVTGKGVHLGFDYWGQGTLVTVSS

SEQ ID NO: 10040 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYAASVKGRFTISRDNSKNTLYLQMSSLRAEDTAVYYCATGKGVHLGFDYWGQGTLVTVSS

SEQ ID NO: 10041 - protein, 116 aa, Artificial Sequence
  Description of Artificial Sequence: Synthetic polypeptide
QVQLVESGGGVVQPGRSLRLSCAASGFTFSTYGMHWVRQAPGKGLEWVAVISYDAETVKYAESVKGRFTISRDNSKNTLYLQMNSLRAEDTAVYYCARGQLLTGYWGQGTLVTVSS

SEQ ID NO: 10042 - protein, 117 aa, Artificial Sequence
  Description of Artificial Sequence: Synthetic polypeptide
QVQLVESGGGLVKPGGSLRLSCAASGFTFSDYYMSWIRQAPGKGLEWVSYISKSSYTVTYADAVKGRFTISRDNAKNSLYLQMNSLRAEDTAVYYCATYNYGHFDYWGQGTLVTVSS

SEQ ID NO: 10043 - protein, 126 aa, Artificial Sequence
  Description of Artificial Sequence: Synthetic polypeptide
QVQLQESGPGLVKPSQTLSLTCTVSGDSISSNPYYWSWIRQHPGKGLEWIGYISYSGITNYNPSLKSRVTMSVDTSKNQFSLKLTSLTAADTAVYYCAREKMWFGVLNYYYGMDVWGQGTTVTVSS

SEQ ID NO: 10044 - protein, 121 aa, Artificial Sequence
  Description of Artificial Sequence: Synthetic polypeptide
QVQLQESGPGLVKPSETLSLTCTVSGDSISSSRYYWGWIRQPPGKGLEWIGSIYYSGSTYYNPSLKSRVTISVDTSKNQFSLKLSSVTAADTAVYYCARGIFGVITYFDYWGQGTLVTVSS

SEQ ID NO: 10045 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSSISGSGGGTYYAASVKGRFTISRDNSKNTLYLQMNSLRAEDTAVYYCATGKGVHLGFDYWGQGTLVTVSS

SEQ ID NO: 10046 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSTISGSGGGTYYADSVKGRFTISRDNSKNTLYLQMNSLRAEDTAVYYCATGKGVHLGFDYWGQGTLVTVSS

SEQ ID NO: 10047 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSTISGSGGGTYYAASVKGRFTISRDNSKNTLYLQMNSLRAEDTAVYYCATGKGVHLGFDYWGQGTLVTVSS

SEQ ID NO: 10048 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNAASVKGRFTISRDNSKNTLYLQMNSLRAEDTAAYYCVTGKGVHLGFDYWGQGTLVTVSS

SEQ ID NO: 10049 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMSSLRAEDTAVYYCVTGKGVHLGFDYWGQGTLVTVSS

SEQ ID NO: 10050 - protein, 119 aa, Artificial Sequence; identical to SEQ ID NO: 10039
  Description of Artificial Sequence: Synthetic polypeptide

SEQ ID NO: 10051 - protein, 119 aa, Artificial Sequence; identical to SEQ ID NO: 9938
  Description of Artificial Sequence: Synthetic polypeptide

SEQ ID NO: 10052 - protein, 119 aa, Artificial Sequence; identical to SEQ ID NO: 10040
  Description of Artificial Sequence: Synthetic polypeptide

SEQ ID NO: 10053 - protein, 127 aa, Artificial Sequence
  Description of Artificial Sequence: Synthetic polypeptide
EVQLVESGGGLVQPGGSLRLSCAASGFTFSNAWMSWVRQAPGKGLEWVGRIKSKTYGGTTDYAAPVKGRFTISRDDSKNTLFLQMNSLKTEDTAVYYCTTPSYSGSYYNYFSVMDVWGQGTTVTVSS

SEQ ID NO: 10054 - protein, 123 aa, Artificial Sequence
  Description of Artificial Sequence: Synthetic polypeptide
QITLKESGPALVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSS

SEQ ID NO: 10055 - protein, 123 aa, Artificial Sequence
  Description of Artificial Sequence: Synthetic polypeptide
QITLKESGPTLVKPTQTLTLTCTFSGFSFTTHKMGVDWIRQPPGKALEWLAGIHIYDDKRYSPSLQSRLTITKDTSKNQVVLTMTNMDPVDTATYYCAYRRYNWNYENWFDPWGQGTLVTVSS

SEQ ID NO: 10056 - protein, 123 aa, Artificial Sequence; identical to SEQ ID NO: 10054
  Description of Artificial Sequence: Synthetic polypeptide

SEQ ID NO: 10057 - protein, 123 aa, Artificial Sequence
  Description of Artificial Sequence: Synthetic polypeptide
QITLKESGPTLVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSS

SEQ ID NO: 10058 - protein, 127 aa, Artificial Sequence
  Description of Artificial Sequence: Synthetic polypeptide
EVQLVESGGGLVQPGGSLRLSCAASGFTFSNAWMSWVRQAPGKGLEWVGRIRSRSYGGTTDYAAPVKGRFTISRDDSKNTLFLQMNSLKTEDTAVYYCTTPSYSGSYYNYFSVMDVWGQGTTVTVSS

SEQ ID NO: 10059 - protein, 127 aa, Artificial Sequence
  Description of Artificial Sequence: Synthetic polypeptide
EVQLVESGGGLVQPGGSLRLSCAASGFTFSNAWMSWVRQAPGKGLEWVGRIKSKTYGGTTDYAAPVKGRFTISRDDSKNTLYLQMNSLKTEDTAVYYCTTPSYSGSYYNYFSVMDVWGQGTTVTVSS

SEQ ID NO: 10060 - protein, 127 aa, Artificial Sequence
  Description of Artificial Sequence: Synthetic polypeptide
EVQLVESGGGLVQPGGSLRLSCAASGFTFSNAWMSWVRQAPGKGLEWVGRITSSRYGGTTDYAAPVKGRFTISRDDSKNTLFLQMNSLKTEDTAVYYCTTPSYSGSYYNYFSVMDVWGQGTTVTVSS

SEQ ID NO: 10061 - protein, 127 aa, Artificial Sequence
  Description of Artificial Sequence: Synthetic polypeptide
EVQLVESGGGLVKPGGSLRLSCAASGFTFSNAWMSWVRQAPGKGLEWVGRILNNAYGGTTDYAAPVKGRFTISRDDSKNTLYLQMNSLKTEDTAVYYCTTPSYSGSYYNYFSVMDVWGQGTTVTVSS

SEQ ID NO: 10062 - protein, 119 aa, Artificial Sequence; identical to SEQ ID NO: 9904
  Description of Artificial Sequence: Synthetic polypeptide

SEQ ID NO: 10063 - protein, 119 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNAASVKGRFTISRDNSKNTLYLQMNSLRAEDTAVYYCATGKGVHLGFDYWGQGTLVTVSS

SEQ ID NO: 10064 - protein, 127 aa, Artificial Sequence
  Description of Artificial Sequence: Synthetic polypeptide
EVQLVESGGGLVQPGGSLRLSCAASGFTFSNAWMSWVRQAPGKGLEWVGRITSGIYGGTTDYAAPVKGRFTISRDDSKNTLYLQMNSLKTEDTAVYYCTTPSYSGSYYNYFSVMDVWGQGTTVTVSS

SEQ ID NO: 10065 - protein, 127 aa, Artificial Sequence
  Description of Artificial Sequence: Synthetic polypeptide
EVQLVESGGGLVQPGGSLRLSCAASGFTFSNAWMSWVRQAPGKGLEWVGRIRSRPYGGTTDYAAPVKGRFTISRDDSKNTLYLQMNSLKTEDTAVYYCTTPSYSGSYYNYFSVMDVWGQGTTVTVSS

SEQ ID NO: 10066 - protein, 116 aa, Artificial Sequence
  Description of Artificial Sequence: Synthetic polypeptide
QVQLVESGGGVVQPGRSLRLSCAASGFTFSTYGMHWVRQAPGKGLEWVAVISYDASNKYYAESVKGRFTISRDNSKNTLYLQMNSLRAEDTAVYYCARGQLLTGYWGQGTLVTVSS

SEQ ID NO: 10067 - protein, 23 aa, Artificial Sequence
  Description of Artificial Sequence: Synthetic peptide
DIVMTQSPDSLAVSLGERATINC

SEQ ID NO: 10068 - protein, 23 aa, Artificial Sequence
  Description of Artificial Sequence: Synthetic peptide
ELVMTQSPSSLAVSVGEKITMSC

SEQ ID NO: 10069 - protein, 23 aa, Artificial Sequence
  Description of Artificial Sequence: Synthetic peptide
ELVMTQSPDSLAVSLGERATINC

SEQ ID NO: 10070 - protein, 23 aa, Artificial Sequence
  Description of Artificial Sequence: Synthetic peptide
ELVMTQSPDSLAVSLGERATINC

SEQ ID NO: 10071 - protein, 23 aa, Artificial Sequence
  Description of Artificial Sequence: Synthetic peptide
EIVLTQSPDFQSVTPKEKVTITC

SEQ ID NO: 10072 - protein, 23 aa, Artificial Sequence
  Description of Artificial Sequence: Synthetic peptide
ELVLTQSPAIMSASPGQKVTITC

SEQ ID NO: 10073 - protein, 23 aa, Artificial Sequence
  Description of Artificial Sequence: Synthetic peptide
AIQMTQSPSSLSASVGDRVTITC

SEQ ID NO: 10074 - protein, 23 aa, Artificial Sequence
  Description of Artificial Sequence: Synthetic peptide
ELQMTQSPASLSASVGETVTITC

SEQ ID NO: 10075 - protein, 23 aa, Artificial Sequence
  Description of Artificial Sequence: Synthetic peptide
DIVMTQSPLSLPVTPGEPASISC

SEQ ID NO: 10076 - protein, 23 aa, Artificial Sequence
  Description of Artificial Sequence: Synthetic peptide
ELVMTQSPLSLPVSPGEPASISC

SEQ ID NO: 10077 - protein, 23 aa, Artificial Sequence
  Description of Artificial Sequence: Synthetic peptide
ELVLTQSPLSLPVTPGEPASISC

SEQ ID NO: 10078 - protein, 23 aa, Artificial Sequence
  Description of Artificial Sequence: Synthetic peptide
DIVMTQSPLSLPVTPGEPASISC

SEQ ID NO: 10079 - protein, 23 aa, Artificial Sequence
  Description of Artificial Sequence: Synthetic peptide
ELVMTQSPLSLPVTPGEPASISC

SEQ ID NO: 10080 - protein, 23 aa, Artificial Sequence
  Description of Artificial Sequence: Synthetic peptide
ELVMTQSPLSLPVTPGEPASISC

SEQ ID NO: 10081 - protein, 23 aa, Artificial Sequence
  Description of Artificial Sequence: Synthetic peptide
ELVLTQSPLSLPVTPGEPASISC

SEQ ID NO: 10082 - protein, 23 aa, Artificial Sequence
  Description of Artificial Sequence: Synthetic peptide
ELVMTQSPLSLPVIPGEPASISC

SEQ ID NO: 10083 - protein, 23 aa, Artificial Sequence
  Description of Artificial Sequence: Synthetic peptide
ELVMTQSPLSLPVTPGEPASISC

SEQ ID NO: 10084 - protein, 23 aa, Artificial Sequence
  Description of Artificial Sequence: Synthetic peptide
ELVLTQSPLSLPVTPGEPASISC

SEQ ID NO: 10085 - protein, 23 aa, Artificial Sequence
  Description of Artificial Sequence: Synthetic peptide
ELVLTQSPLSLPVTPGEPASISC

SEQ ID NO: 10086 - protein, 23 aa, Artificial Sequence
  Description of Artificial Sequence: Synthetic peptide
ELVMTQSPLSLPVTPGEPASISC

SEQ ID NO: 10087 - protein, 23 aa, Artificial Sequence
  Description of Artificial Sequence: Synthetic peptide
DIVMTQTPLSLPVTPGEPASISC

SEQ ID NO: 10088 - protein, 23 aa, Artificial Sequence
  Description of Artificial Sequence: Synthetic peptide
ELVMTQTPLSLPVIPGEPASISC

SEQ ID NO: 10089 - protein, 23 aa, Artificial Sequence
  Description of Artificial Sequence: Synthetic peptide
ELVMTQTPLSLPVTPGEPASISC

SEQ ID NO: 10090 - protein, 23 aa, Artificial Sequence
  Description of Artificial Sequence: Synthetic peptide
ELVMTQTPLSLPVTPGEPASISC

SEQ ID NO: 10091 - protein, 23 aa, Artificial Sequence
  Description of Artificial Sequence: Synthetic peptide
ELVMTQTPLSLPVTPGEPASISC

SEQ ID NO: 10092 - protein, 23 aa, Artificial Sequence
  Description of Artificial Sequence: Synthetic peptide
ELVMTQTPLSLPVTPGEPASISC

SEQ ID NO: 10093 - protein, 23 aa, Artificial Sequence
  Description of Artificial Sequence: Synthetic peptide
ELVMTQTPLSLPVTPGEPASISC

SEQ ID NO: 10094 - protein, 23 aa, Artificial Sequence
  Description of Artificial Sequence: Synthetic peptide
DIVMTQTPLSLPVTPGEPASISC

SEQ ID NO: 10095 - protein, 23 aa, Artificial Sequence
  Description of Artificial Sequence: Synthetic peptide
EIVLTQSPGTLSLSPGERATLSC

SEQ ID NO: 10096 - protein, 23 aa, Artificial Sequence
  Description of Artificial Sequence: Synthetic peptide
ELTLTQSPGTLSLSPGERATLSC

SEQ ID NO: 10097 - protein, 23 aa, Artificial Sequence
  Description of Artificial Sequence: Synthetic peptide
ELTLTQSPGTLSLSPGERATLSC

SEQ ID NO: 10098 - protein, 23 aa, Artificial Sequence
  Description of Artificial Sequence: Synthetic peptide
EIVLTQSPGTLSLSPGERATLSC

SEQ ID NO: 10099 - protein, 23 aa, Artificial Sequence
  Description of Artificial Sequence: Synthetic peptide
ELVLTQSPGTLSLSPGERATLSC

SEQ ID NO: 10100 - protein, 23 aa, Artificial Sequence
  Description of Artificial Sequence: Synthetic peptide
ELVLTQSPGTLSLSPGERATLSC

SEQ ID NO: 10101 - protein, 23 aa, Artificial Sequence
  Description of Artificial Sequence: Synthetic peptide
ELTLTQSPGTLSLSPGERATLSC

SEQ ID NO: 10102 - protein, 23 aa, Artificial Sequence
  Description of Artificial Sequence: Synthetic peptide
ELTLTQSPGTLSLSPGERATLSC

SEQ ID NO: 10103 - protein, 23 aa, Artificial Sequence
  Description of Artificial Sequence: Synthetic peptide
ELVMTQSPGTLSLSPGERATLSC

SEQ ID NO: 10104 - protein, 23 aa, Artificial Sequence
  Description of Artificial Sequence: Synthetic peptide
DIVMTQSPLSLPVTPGEPASISC

SEQ ID NO: 10105 - protein, 23 aa, Artificial Sequence
  Description of Artificial Sequence: Synthetic peptide
ELVMTQSPLSLPVTPGEPASISC

SEQ ID NO: 10106 - protein, 23 aa, Artificial Sequence
  Description of Artificial Sequence: Synthetic peptide
ELVLTQSPLSLPVTPGEPASISC

SEQ ID NO: 10107 - protein, 23 aa, Artificial Sequence
  Description of Artificial Sequence: Synthetic peptide
ELVMTQSPLSLPVTPGEPASISC

SEQ ID NO: 10108 - protein, 23 aa, Artificial Sequence
  Description of Artificial Sequence: Synthetic peptide
ELVMTQSPLSLPVTPGEPASISC

SEQ ID NO: 10109 - protein, 23 aa, Artificial Sequence
  Description of Artificial Sequence: Synthetic peptide
ELVMTQSPLSLPVTPGEPASISC

SEQ ID NO: 10110 - protein, 23 aa, Artificial Sequence
  Description of Artificial Sequence: Synthetic peptide
ELVLTQSPLSLPVTPGEPASISC

SEQ ID NO: 10111 - protein, 23 aa, Artificial Sequence
  Description of Artificial Sequence: Synthetic peptide
ELVLTQSPLSLPVTPGEPASISC

SEQ ID NO: 10112 - protein, 23 aa, Artificial Sequence
  Description of Artificial Sequence: Synthetic peptide
ELVLTQSPLSLPVTPGEPASISC

SEQ ID NO: 10113 - protein, 23 aa, Artificial Sequence
  Description of Artificial Sequence: Synthetic peptide
ELVLTQSPLSLPVTPGEPASISC

SEQ ID NO: 10114 - protein, 23 aa, Artificial Sequence
  Description of Artificial Sequence: Synthetic peptide
ELVMTQSPLSLPVTPGEPASISC

SEQ ID NO: 10115 - protein, 23 aa, Artificial Sequence
  Description of Artificial Sequence: Synthetic peptide
ELVLTQSPLSLPVTPGEPASISC

SEQ ID NO: 10116 - protein, 23 aa, Artificial Sequence
  Description of Artificial Sequence: Synthetic peptide
DIQMTQSPSSVSASVGDRVTITC

SEQ ID NO: 10117 - protein, 23 aa, Artificial Sequence
  Description of Artificial Sequence: Synthetic peptide
ELQMTQSPSSVSASVGDRVTITC

SEQ ID NO: 10118 - protein, 23 aa, Artificial Sequence
  Description of Artificial Sequence: Synthetic peptide
ELQMTQSPSSVSASVGDRVTITC

SEQ ID NO: 10119 - protein, 23 aa, Artificial Sequence
  Description of Artificial Sequence: Synthetic peptide
DIVMTQSPLSLPVTPGEPASISC

SEQ ID NO: 10120 - protein, 23 aa, Artificial Sequence
  Description of Artificial Sequence: Synthetic peptide
ELVMTQSPLSLPVTPGEPASISC

SEQ ID NO: 10121 - protein, 23 aa, Artificial Sequence
  Description of Artificial Sequence: Synthetic peptide
ELVLTQSPLSLPVSPGEPASISC

SEQ ID NO: 10122 - protein, 23 aa, Artificial Sequence
  Description of Artificial Sequence: Synthetic peptide
ELVLTQSPLSLPVTPGEPASISC

SEQ ID NO: 10123 - protein, 23 aa, Artificial Sequence
  Description of Artificial Sequence: Synthetic peptide
ELVMTQSPLSLSVTPGEPASISC

SEQ ID NO: 10124 - protein, 23 aa, Artificial Sequence
  Description of Artificial Sequence: Synthetic peptide
ELVMTQSPLSLPVTPGEPASISC

SEQ ID NO: 10125 - protein, 23 aa, Artificial Sequence
  Description of Artificial Sequence: Synthetic peptide
DIVMTQTPLSLPVTPGEPASISC

SEQ ID NO: 10126 - protein, 23 aa, Artificial Sequence
  Description of Artificial Sequence: Synthetic peptide
ELVMTQTPLSLPVSPGEPASISC

SEQ ID NO: 10127 - protein, 23 aa, Artificial Sequence
  Description of Artificial Sequence: Synthetic peptide
ELVMTQTPLSLPVTPGEPASISC

SEQ ID NO: 10128 - protein, 23 aa, Artificial Sequence
  Description of Artificial Sequence: Synthetic peptide
DIQMTQSPSSLSASVGDRVTITC

SEQ ID NO: 10129 - protein, 23 aa, Artificial Sequence
  Description of Artificial Sequence: Synthetic peptide
ELQMTQSPSSLSASVGDRVTITC

SEQ ID NO: 10130 - protein, 23 aa, Artificial Sequence
  Description of Artificial Sequence: Synthetic peptide
ELVMTQSPSSLSASVGDRVTITC

SEQ ID NO: 10131 - protein, 23 aa, Artificial Sequence
  Description of Artificial Sequence: Synthetic peptide
ELVMTQSPSSLSASVGDRVTITC

SEQ ID NO: 10132 - protein, 23 aa, Artificial Sequence
  Description of Artificial Sequence: Synthetic peptide
ELVMTQSPSSLSASVGDRVTITC

SEQ ID NO: 10133 - protein, 23 aa, Artificial Sequence
  Description of Artificial Sequence: Synthetic peptide
DIQMTQSPSSLSASVGDRVTITC

SEQ ID NO: 10134 - protein, 23 aa, Artificial Sequence
  Description of Artificial Sequence: Synthetic peptide
DIQMTQSPSSLSASVGDRVTITC

SEQ ID NO: 10135 - protein, 23 aa, Artificial Sequence
  Description of Artificial Sequence: Synthetic peptide
DIQMTQSPSSLSASVGDRVTITC

SEQ ID NO: 10136 - protein, 23 aa, Artificial Sequence
  Description of Artificial Sequence: Synthetic peptide
DIVMTQTPLSLPVTPGEPASISC

SEQ ID NO: 10137 - protein, 23 aa, Artificial Sequence
  Description of Artificial Sequence: Synthetic peptide
ELVMTQTPLSLPVSPGEPASISC

SEQ ID NO: 10138 - protein, 23 aa, Artificial Sequence
  Description of Artificial Sequence: Synthetic peptide
ELVMTQTPLSLPVTPGEPASISC

SEQ ID NO: 10139 - protein, 23 aa, Artificial Sequence
  Description of Artificial Sequence: Synthetic peptide
DIVMTQSPLSLPVTPGEPASISC

SEQ ID NO: 10140 - protein, 23 aa, Artificial Sequence
  Description of Artificial Sequence: Synthetic peptide
ELVMTQSPLSLPVTPGEPASISC

SEQ ID NO: 10141 - protein, 23 aa, Artificial Sequence
  Description of Artificial Sequence: Synthetic peptide
ELVMTQSPLSLPVSPGEPASISC

SEQ ID NO: 10142 - protein, 23 aa, Artificial Sequence
  Description of Artificial Sequence: Synthetic peptide
ELVLTQSPLSLPVTPGEPASISC

SEQ ID NO: 10143 - protein, 23 aa, Artificial Sequence
  Description of Artificial Sequence: Synthetic peptide
ELVLTQSPLSLPVTPGEPASISC

SEQ ID NO: 10144 - protein, 23 aa, Artificial Sequence
  Description of Artificial Sequence: Synthetic peptide
ELVMTQSPLSLPVTPGEPASISC

SEQ ID NO: 10145 - protein, 23 aa, Artificial Sequence
  Description of Artificial Sequence: Synthetic peptide
ELVMTQSPLSLPVTPGEPASISC

SEQ ID NO: 10146 - protein, 23 aa, Artificial Sequence
  Description of Artificial Sequence: Synthetic peptide
ELVMTQSPLSLPVTPGEPASISC

SEQ ID NO: 10147 - protein, 23 aa, Artificial Sequence
  Description of Artificial Sequence: Synthetic peptide
ELVMTQSPLSLPVTPGEPASISC

SEQ ID NO: 10148 - protein, 23 aa, Artificial Sequence
  Description of Artificial Sequence: Synthetic peptide
ELVMTQSPLSLPVTPGEPASISC

SEQ ID NO: 10149 - protein, 23 aa, Artificial Sequence
  Description of Artificial Sequence: Synthetic peptide
DIVMTQTPLSLPVTPGEPASISC

SEQ ID NO: 10150 - protein, 23 aa, Artificial Sequence
  Description of Artificial Sequence: Synthetic peptide
ELVMTQTPLSLPVIPGEPASISC

SEQ ID NO: 10151 - protein, 23 aa, Artificial Sequence
  Description of Artificial Sequence: Synthetic peptide
ELVMTQTPLSLPVTPGEPASISC

SEQ ID NO: 10152 - protein, 23 aa, Artificial Sequence
  Description of Artificial Sequence: Synthetic peptide
ELVMTQTPLSLPVTPGEPASISC

SEQ ID NO: 10153 - protein, 23 aa, Artificial Sequence
  Description of Artificial Sequence: Synthetic peptide
DIQMTQSPSSLSASVGDRVTITC

SEQ ID NO: 10154 - protein, 23 aa, Artificial Sequence
  Description of Artificial Sequence: Synthetic peptide
ELQMTQSPSSLSASVGDRVTITC

SEQ ID NO: 10155 - protein, 23 aa, Artificial Sequence
  Description of Artificial Sequence: Synthetic peptide
ELQMTQSPSSLSASVGDRVTITC

SEQ ID NO: 10156 - protein, 23 aa, Artificial Sequence
  Description of Artificial Sequence: Synthetic peptide
ELVMTQSPSSLSASVGDRVTITC

SEQ ID NO: 10157 - protein, 23 aa, Artificial Sequence
  Description of Artificial Sequence: Synthetic peptide
ELVMTQSPSSLSASVGDRVTITC

SEQ ID NO: 10158 - protein, 23 aa, Artificial Sequence
  Description of Artificial Sequence: Synthetic peptide
DIQMTQSPSSLSASVGDRVTITC

SEQ ID NO: 10159 - protein, 23 aa, Artificial Sequence
  Description of Artificial Sequence: Synthetic peptide
DIQMTQSPSSLSASVGDRVTITC

SEQ ID NO: 10160 - protein, 23 aa, Artificial Sequence
  Description of Artificial Sequence: Synthetic peptide
DIVMTQTPLSLPVTPGEPASISC

SEQ ID NO: 10161 - protein, 23 aa, Artificial Sequence
  Description of Artificial Sequence: Synthetic peptide
ELVMTQTPLSLPVTPGEPASISC

SEQ ID NO: 10162 - protein, 23 aa, Artificial Sequence
  Description of Artificial Sequence: Synthetic peptide
DIQMTQSPSSLSASVGDRVTITC

SEQ ID NO: 10163 - protein, 23 aa, Artificial Sequence
  Description of Artificial Sequence: Synthetic peptide
ELVMTQSPSSLSASVGDRVTITC

SEQ ID NO: 10164 - protein, 23 aa, Artificial Sequence
  Description of Artificial Sequence: Synthetic peptide
DIVMTQTPLSLSVTPGQPASISC

SEQ ID NO: 10165 - protein, 23 aa, Artificial Sequence
  Description of Artificial Sequence: Synthetic peptide
ELVMTQSPLSLSVTPGQPASISC

SEQ ID NO: 10166 - protein, 23 aa, Artificial Sequence
  Description of Artificial Sequence: Synthetic peptide
DIVMTQSPDSLAVSLGERATINC

SEQ ID NO: 10167 - protein, 23 aa, Artificial Sequence
  Description of Artificial Sequence: Synthetic peptide
ELVMTQSPDSLAVSLGERATINC

SEQ ID NO: 10168 - protein, 23 aa, Artificial Sequence
  Description of Artificial Sequence: Synthetic peptide
ELVMTQSPDSLAVSLGERATINC

SEQ ID NO: 10169 - protein, 23 aa, Artificial Sequence
  Description of Artificial Sequence: Synthetic peptide
ELVMTQSPDSLAVSLGERATINC

SEQ ID NO: 10170 - protein, 23 aa, Artificial Sequence
  Description of Artificial Sequence: Synthetic peptide
DIQMTQSPSSLSASVGDRVTITC

SEQ ID NO: 10171 - protein, 23 aa, Artificial Sequence
  Description of Artificial Sequence: Synthetic peptide
ELVMTQSPSSLSASVGDRVTITC

SEQ ID NO: 10172 - protein, 23 aa, Artificial Sequence
  Description of Artificial Sequence: Synthetic peptide
DIVMTQSPDSLAVSLGERATINC

SEQ ID NO: 10173 - protein, 23 aa, Artificial Sequence
  Description of Artificial Sequence: Synthetic peptide
ELVMTQSPDSLAVSLGERATINC

SEQ ID NO: 10174 - protein, 23 aa, Artificial Sequence
  Description of Artificial Sequence: Synthetic peptide
ELVMTQSPDSLAVSLGERATINC

SEQ ID NO: 10175 - protein, 23 aa, Artificial Sequence
  Description of Artificial Sequence: Synthetic peptide
ELVMTQSPDSLAVSLGERATINC

SEQ ID NO: 10176 - protein, 23 aa, Artificial Sequence
  Description of Artificial Sequence: Synthetic peptide
ELVMTQTPDSLAVSLGERATINC

SEQ ID NO: 10177 - protein, 23 aa, Artificial Sequence
  Description of Artificial Sequence: Synthetic peptide
DIQMTQSPSSLSASVGDRVTITC

SEQ ID NO: 10178 - protein, 23 aa, Artificial Sequence
  Description of Artificial Sequence: Synthetic peptide
ELVMTQSPSSLSASVGDRVTITC

SEQ ID NO: 10179 - protein, 23 aa, Artificial Sequence
  Description of Artificial Sequence: Synthetic peptide
ELQMTQSPSSLSASVGDRVTITC

SEQ ID NO: 10180 - protein, 23 aa, Artificial Sequence
  Description of Artificial Sequence: Synthetic peptide
ELQMTQSPSSLSASVGDRVTITC

SEQ ID NO: 10181 - protein, 23 aa, Artificial Sequence
  Description of Artificial Sequence: Synthetic peptide
ELVMTQSPSSLSASVGDRVTITC

SEQ ID NO: 10182 - protein, 23 aa, Artificial Sequence
  Description of Artificial Sequence: Synthetic peptide
ELVMTQSPSSLSASVGDRVTITC

SEQ ID NO: 10183 - protein, 23 aa, Artificial Sequence
  Description of Artificial Sequence: Synthetic peptide
ELVMTQSPSSLSASVGDRVTITC

SEQ ID NO: 10184 - protein, 23 aa, Artificial Sequence
  Description of Artificial Sequence: Synthetic peptide
ELVMTQSPSSLSASVGDRVTITC

SEQ ID NO: 10185 - protein, 23 aa, Artificial Sequence
  Description of Artificial Sequence: Synthetic peptide
DIQMTQSPSSLSASVGDRVTITC

SEQ ID NO: 10186 - protein, 23 aa, Artificial Sequence
  Description of Artificial Sequence: Synthetic peptide
DIQMTQSPSSLSASVGDRVTITC

SEQ ID NO: 10187 - protein, 23 aa, Artificial Sequence
  Description of Artificial Sequence: Synthetic peptide
DIQMTQSPSSLSASVGDRVTITC

SEQ ID NO: 10188 - protein, 23 aa, Artificial Sequence
  Description of Artificial Sequence: Synthetic peptide
ELQMTQSPSSLSASVGDRVTITC

SEQ ID NO: 10189 - protein, 23 aa, Artificial Sequence
  Description of Artificial Sequence: Synthetic peptide
ELQMTQSPSSLSASVGDRVTITC

SEQ ID NO: 10190 - protein, 23 aa, Artificial Sequence
  Description of Artificial Sequence: Synthetic peptide
ELVMTQSPSSLSASVGDRVTITC

SEQ ID NO: 10191 - protein, 23 aa, Artificial Sequence
  Description of Artificial Sequence: Synthetic peptide
DIQMTQSPSSLSASVGDRVTITC

SEQ ID NO: 10192 - protein, 23 aa, Artificial Sequence
  Description of Artificial Sequence: Synthetic peptide
DIQMTQSPSSLSASVGDRVTITC

SEQ ID NO: 10193 - protein, 23 aa, Artificial Sequence
  Description of Artificial Sequence: Synthetic peptide
ELQMTQSPSSLSASVGDRVTITC

SEQ ID NO: 10194 - protein, 23 aa, Artificial Sequence
  Description of Artificial Sequence: Synthetic peptide
ELVMTQSPSSLSASVGDRVTITC

SEQ ID NO: 10195 - protein, 23 aa, Artificial Sequence
  Description of Artificial Sequence: Synthetic peptide
ELVMTQSPSSLSASVGDRVTITC

SEQ ID NO: 10196 - protein, 23 aa, Artificial Sequence
  Description of Artificial Sequence: Synthetic peptide
ELVMTQSPSSLSASVGDRVTITC

SEQ ID NO: 10197 - protein, 23 aa, Artificial Sequence
  Description of Artificial Sequence: Synthetic peptide
ELVMTQSPSSLSASVGDRVTITC

SEQ ID NO: 10198 - protein, 23 aa, Artificial Sequence
  Description of Artificial Sequence: Synthetic peptide
ELVMTQSPSSLSASVGDRVTITC

SEQ ID NO: 10199 - protein, 23 aa, Artificial Sequence
  Description of Artificial Sequence: Synthetic peptide
ELQMTQSPSSLSASVGDRVTITC

SEQ ID NO: 10200 - protein, 23 aa, Artificial Sequence
  Description of Artificial Sequence: Synthetic peptide
ELQMTQSPSSLSASVGDRVTITC

SEQ ID NO: 10201 - protein, 23 aa, Artificial Sequence
  Description of Artificial Sequence: Synthetic peptide
ELQMTQSPSSLSASVGDRVTITC

SEQ ID NO: 10202 - protein, 23 aa, Artificial Sequence
  Description of Artificial Sequence: Synthetic peptide
ELVMTQSPSSLSASVGDRVTITC

SEQ ID NO: 10203 - protein, 23 aa, Artificial Sequence
  Description of Artificial Sequence: Synthetic peptide
ELQMTQSPSSLSASVGDRVTITC

SEQ ID NO: 10204 - protein, 23 aa, Artificial Sequence
  Description of Artificial Sequence: Synthetic peptide
ELVMTQSPSSLSASVGDRVTITC

SEQ ID NO: 10205 - protein, 23 aa, Artificial Sequence
  Description of Artificial Sequence: Synthetic peptide
ELQMTQSPSSLSASVGDRVTITC

SEQ ID NO: 10206 - protein, 23 aa, Artificial Sequence
  Description of Artificial Sequence: Synthetic peptide
ELVMTQSPSSLSASVGDRVTITC

SEQ ID NO: 10207 - protein, 23 aa, Artificial Sequence
  Description of Artificial Sequence: Synthetic peptide
ELVMTQSPSSLSASVGDRVTITC

SEQ ID NO: 10208 - protein, 23 aa, Artificial Sequence
  Description of Artificial Sequence: Synthetic peptide
ELVMTQSPSSLSASVGDRVTITC

SEQ ID NO: 10209 - protein, 23 aa, Artificial Sequence
  Description of Artificial Sequence: Synthetic peptide
DIQMTQSPSSLSASVGDRVTITC

SEQ ID NO: 10210 - protein, 23 aa, Artificial Sequence
  Description of Artificial Sequence: Synthetic peptide
DIQMTQSPSSLSASVGDRVTITC

SEQ ID NO: 10211 - protein, 23 aa, Artificial Sequence
  Description of Artificial Sequence: Synthetic peptide
DIQMTQSPSSLSASVGDRVTITC

SEQ ID NO: 10212 - protein, 23 aa, Artificial Sequence
  Description of Artificial Sequence: Synthetic peptide
DIQMTQSPSSLSASVGDRVTITC

SEQ ID NO: 10213 - protein, 23 aa, Artificial Sequence
  Description of Artificial Sequence: Synthetic peptide
DIQMTQSPSSLSASVGDRVTITC

SEQ ID NO: 10214 - protein, 23 aa, Artificial Sequence
  Description of Artificial Sequence: Synthetic peptide
DIQMTQSPSSVSASVGDRVTITC

SEQ ID NO: 10215 - protein, 23 aa, Artificial Sequence
  Description of Artificial Sequence: Synthetic peptide
ELQMTQSPSSVSASVGDRVTITC

SEQ ID NO: 10216 - protein, 23 aa, Artificial Sequence
  Description of Artificial Sequence: Synthetic peptide
EIVLTQSPGTLSLSPGERATLSC

SEQ ID NO: 10217 - protein, 23 aa, Artificial Sequence
  Description of Artificial Sequence: Synthetic peptide
ELVLTQSPGTLSLSPGERATLSC

SEQ ID NO: 10218 - protein, 23 aa, Artificial Sequence
  Description of Artificial Sequence: Synthetic peptide
DIQMTQSPSSLSASVGDRVTITC

SEQ ID NO: 10219 - protein, 23 aa, Artificial Sequence
  Description of Artificial Sequence: Synthetic peptide
ELVMTQSPSSLSASVGDRVTITC

SEQ ID NO: 10220 - protein, 23 aa, Artificial Sequence
  Description of Artificial Sequence: Synthetic peptide
DIVMTQSPDSLAVSLGERATINC

SEQ ID NO: 10221 - protein, 23 aa, Artificial Sequence
  Description of Artificial Sequence: Synthetic peptide
ELVMTQSPDSLAVSLGERATINC

SEQ ID NO: 10222 - protein, 23 aa, Artificial Sequence
  Description of Artificial Sequence: Synthetic peptide
DIVMTQSPDSLAVSLGERATINC

SEQ ID NO: 10223 - protein, 23 aa, Artificial Sequence
  Description of Artificial Sequence: Synthetic peptide
DIQMTQSPSSLSASVGDRVTITC

SEQ ID NO: 10224 - protein, 23 aa, Artificial Sequence
  Description of Artificial Sequence: Synthetic peptide
ELVMTQSPDSLSASVGDRVTITC

SEQ ID NO: 10225 - protein, 22 aa, Artificial Sequence
  Description of Artificial Sequence: Synthetic peptide
QSALTQPASVSGSPGQSITISC

SEQ ID NO: 10226 - protein, 22 aa, Artificial Sequence
  Description of Artificial Sequence: Synthetic peptide
ELALTQPPSVSGSPGQSITISC

SEQ ID NO: 10227 - protein, 22 aa, Artificial Sequence
  Description of Artificial Sequence: Synthetic peptide
QSVLTQPPSASGTPGQRVTISC

SEQ ID NO: 10228 - protein, 22 aa, Artificial Sequence
  Description of Artificial Sequence: Synthetic peptide
ELVLTQPPSASGTPGQRITISC

SEQ ID NO: 10229 - protein, 22 aa, Artificial Sequence
  Description of Artificial Sequence: Synthetic peptide
QAGLTQPPSVSKGLRQTATLTC

SEQ ID NO: 10230 - protein, 22 aa, Artificial Sequence
  Description of Artificial Sequence: Synthetic peptide
ELVLTQPPSVSKGLRQTATLTC

SEQ ID NO: 10231 - protein, 22 aa, Artificial Sequence
  Description of Artificial Sequence: Synthetic peptide
ELVLTQPSSVSKDLRQTATLTC

SEQ ID NO: 10232 - protein, 22 aa, Artificial Sequence
  Description of Artificial Sequence: Synthetic peptide
QSALTQPPSASGSPGQSVTISC

SEQ ID NO: 10233 - protein, 22 aa, Artificial Sequence
  Description of Artificial Sequence: Synthetic peptide
ELALTQPASASGSPGQSITISC

SEQ ID NO: 10234 - protein, 22 aa, Artificial Sequence
  Description of Artificial Sequence: Synthetic peptide
QAGLTQPPSVSKGLRQTATLTC

SEQ ID NO: 10235 - protein, 22 aa, Artificial Sequence
  Description of Artificial Sequence: Synthetic peptide
ELVLTQLPSVSKGLRQTATLTC

SEQ ID NO: 10236 - protein, 22 aa, Artificial Sequence
  Description of Artificial Sequence: Synthetic peptide
SYVLTQPPSVSVAPGKTARITC

SEQ ID NO: 10237 - protein, 22 aa, Artificial Sequence
  Description of Artificial Sequence: Synthetic peptide
ELVLTQPPSVSVAPGQTARITC

SEQ ID NO: 10238 - protein, 22 aa, Artificial Sequence
  Description of Artificial Sequence: Synthetic peptide
ELVLTQPPSVSVAPGQTARITC

SEQ ID NO: 10239 - protein, 22 aa, Artificial Sequence
  Description of Artificial Sequence: Synthetic peptide
ELVVTQEPSVSVAPGQTARITC

SEQ ID NO: 10240 - protein, 22 aa, Artificial Sequence
  Description of Artificial Sequence: Synthetic peptide
ELVLTQLPSVSVAPGQTARITC

SEQ ID NO: 10241 - protein, 22 aa, Artificial Sequence
  Description of Artificial Sequence: Synthetic peptide
ELVLTQSSSVSVAPGQTARITC

SEQ ID NO: 10242 - protein, 22 aa, Artificial Sequence
  Description of Artificial Sequence: Synthetic peptide
ELVLTQPPSVSVTPGQTARITC

SEQ ID NO: 10243 - protein, 22 aa, Artificial Sequence
  Description of Artificial Sequence: Synthetic peptide
ELVLTQLPSVSVAPGQTARITC

SEQ ID NO: 10244 - protein, 22 aa, Artificial Sequence
  Description of Artificial Sequence: Synthetic peptide
ELMLTQPPSVSVAPGQTARITC

SEQ ID NO: 10245 - protein, 22 aa, Artificial Sequence
  Description of Artificial Sequence: Synthetic peptide
ELMLTQPHSVSVAPGQTARITC

SEQ ID NO: 10246 - protein, 22 aa, Artificial Sequence
  Description of Artificial Sequence: Synthetic peptide
ELMLTQPHSVSVAPGQTARITC

SEQ ID NO: 10247 - protein, 22 aa, Artificial Sequence
  Description of Artificial Sequence: Synthetic peptide
ELMLTQPHSVSVAPGQTARITC

SEQ ID NO: 10248 - protein, 22 aa, Artificial Sequence
  Description of Artificial Sequence: Synthetic peptide
ELVLTQPPSVSVAPGQTARITC

SEQ ID NO: 10249 - protein, 22 aa, Artificial Sequence
  Description of Artificial Sequence: Synthetic peptide
ELVLTQPPSVSVAPGQTARITC

SEQ ID NO: 10250 - protein, 22 aa, Artificial Sequence
  Description of Artificial Sequence: Synthetic peptide
ELMLTQPHSVSVAPGQTARITC

SEQ ID NO: 10251 - protein, 22 aa, Artificial Sequence
  Description of Artificial Sequence: Synthetic peptide
ELVLTQPASVSVAPGQTARITC

SEQ ID NO: 10252 - protein, 22 aa, Artificial Sequence
  Description of Artificial Sequence: Synthetic peptide
ELVLTQSSSVSVAPGQTARITC

SEQ ID NO: 10253 - protein, 22 aa, Artificial Sequence
  Description of Artificial Sequence: Synthetic peptide
ELMLTQPHSVSVAPGQTARITC

SEQ ID NO: 10254 - protein, 22 aa, Artificial Sequence
  Description of Artificial Sequence: Synthetic peptide
ELALTQPASASVAPGQTARITC

SEQ ID NO: 10255 - protein, 22 aa, Artificial Sequence
  Description of Artificial Sequence: Synthetic peptide
ELVLTQLSSVSVAPGQTARITC

SEQ ID NO: 10256 - protein, 22 aa, Artificial Sequence
  Description of Artificial Sequence: Synthetic peptide
ELVVTQEPSVSVAPGQTARITC

SEQ ID NO: 10257 - protein, 22 aa, Artificial Sequence
  Description of Artificial Sequence: Synthetic peptide
ELMLTQPPSVSVAPGQTARITC

SEQ ID NO: 10258 - protein, 22 aa, Artificial Sequence
  Description of Artificial Sequence: Synthetic peptide
ELVLTQPPSVSVAPGQTARITC

SEQ ID NO: 10259 - protein, 22 aa, Artificial Sequence
  Description of Artificial Sequence: Synthetic peptide
ELVLTQPPSVSVAPGQTARITC

SEQ ID NO: 10260 - protein, 22 aa, Artificial Sequence
  Description of Artificial Sequence: Synthetic peptide
ELVLTQPASVSVAPGQTARITC

SEQ ID NO: 10261 - protein, 22 aa, Artificial Sequence
  Description of Artificial Sequence: Synthetic peptide
ELMLTQPHSVSVAPGQTARITC

SEQ ID NO: 10262 - protein, 22 aa, Artificial Sequence
  Description of Artificial Sequence: Synthetic peptide
ELVLTQSPSVSVAPGQTARITC

SEQ ID NO: 10263 - protein, 22 aa, Artificial Sequence
  Description of Artificial Sequence: Synthetic peptide
ELALTQPPSVSVAPGQTARITC

SEQ ID NO: 10264 - protein, 22 aa, Artificial Sequence
  Description of Artificial Sequence: Synthetic peptide
ELVLTQPPSVSVAPGQTARITC

SEQ ID NO: 10265 - protein, 22 aa, Artificial Sequence
  Description of Artificial Sequence: Synthetic peptide
ELVLTQPPSVSVAPGQTARITC

SEQ ID NO: 10266 - protein, 22 aa, Artificial Sequence
  Description of Artificial Sequence: Synthetic peptide
ELVLTQPPSVSVAPGQTARITC

SEQ ID NO: 10267 - protein, 22 aa, Artificial Sequence
  Description of Artificial Sequence: Synthetic peptide
ELVLTQPASVSVAPGQTARITC

SEQ ID NO: 10268 - protein, 22 aa, Artificial Sequence
  Description of Artificial Sequence: Synthetic peptide
ELALTQPASASVAPGQTARISC

SEQ ID NO: 10269 - protein, 22 aa, Artificial Sequence
  Description of Artificial Sequence: Synthetic peptide
ELVLTQPPSVSVAPGQTARITC

SEQ ID NO: 10270 - protein, 22 aa, Artificial Sequence
  Description of Artificial Sequence: Synthetic peptide
ELVVTQEPSVSVAPGQTARITC

SEQ ID NO: 10271 - protein, 22 aa, Artificial Sequence
  Description of Artificial Sequence: Synthetic peptide
ELVLTQPPSVSVAPGQTARITC

SEQ ID NO: 10272 - protein, 22 aa, Artificial Sequence
  Description of Artificial Sequence: Synthetic peptide
ELVLTQPPSVSVAPGQTARITC

SEQ ID NO: 10273 - protein, 22 aa, Artificial Sequence
  Description of Artificial Sequence: Synthetic peptide
ELVLTQPPSVSVAPGQTARITC

SEQ ID NO: 10274 - protein, 22 aa, Artificial Sequence
  Description of Artificial Sequence: Synthetic peptide
ELVLTQPSSVSVAPGQTARITC

SEQ ID NO: 10275 - protein, 22 aa, Artificial Sequence
  Description of Artificial Sequence: Synthetic peptide
ELVLTQPPSVSVAPGQTARITC

SEQ ID NO: 10276 - protein, 22 aa, Artificial Sequence
  Description of Artificial Sequence: Synthetic peptide
ELVLTQPPSVSVAPGQTARITC

SEQ ID NO: 10277 - protein, 22 aa, Artificial Sequence
  Description of Artificial Sequence: Synthetic peptide
ELMLTQPHSVSVAPGQTARITC

SEQ ID NO: 10278 - protein, 22 aa, Artificial Sequence
  Description of Artificial Sequence: Synthetic peptide
ELVLTQPPSVSVAPGQTARITC

SEQ ID NO: 10279 - protein, 22 aa, Artificial Sequence
  Description of Artificial Sequence: Synthetic peptide
ELALTQPASASVAPGQTARITC

SEQ ID NO: 10280 - protein, 22 aa, Artificial Sequence
  Description of Artificial Sequence: Synthetic peptide
ELVLTQPPSVSVAPGQTARITC

SEQ ID NO: 10281 - protein, 22 aa, Artificial Sequence
  Description of Artificial Sequence: Synthetic peptide
ELVLTQPPSVSVAPGQTARITC

SEQ ID NO: 10282 - protein, 22 aa, Artificial Sequence
  Description of Artificial Sequence: Synthetic peptide
ELVLTQPPSVSVAPGQTARITC

SEQ ID NO: 10283 - protein, 22 aa, Artificial Sequence
  Description of Artificial Sequence: Synthetic peptide
ELVLTQPPSVSVAPGQTARITC

SEQ ID NO: 10284 - protein, 22 aa, Artificial Sequence
  Description of Artificial Sequence: Synthetic peptide
SYVLTQPPSVSVAPGQTARITC

SEQ ID NO: 10285 - protein, 22 aa, Artificial Sequence
  Description of Artificial Sequence: Synthetic peptide
SYVLTQPPSVSVAPGQTARITC

SEQ ID NO: 10286 - protein, 22 aa, Artificial Sequence
  Description of Artificial Sequence: Synthetic peptide
SYVLTQPPSVSVAPGQTARITC

SEQ ID NO: 10287 - protein, 22 aa, Artificial Sequence
  Description of Artificial Sequence: Synthetic peptide
SYVLTQPPSVSVAPGQTARITC

SEQ ID NO: 10288 - protein, 22 aa, Artificial Sequence
  Description of Artificial Sequence: Synthetic peptide
SYVLTQPPSVSVAPGQTARITC

SEQ ID NO: 10289 - protein, 22 aa, Artificial Sequence
  Description of Artificial Sequence: Synthetic peptide
SYVLTQPPSVSVAPGQTARITC

SEQ ID NO: 10290 - protein, 22 aa, Artificial Sequence
  Description of Artificial Sequence: Synthetic peptide
SYVLTQPPSVSVAPGQTARITC

SEQ ID NO: 10291 - protein, 22 aa, Artificial Sequence
  Description of Artificial Sequence: Synthetic peptide
SYVLTQPPSVSVAPGQTARITC

SEQ ID NO: 10292 - protein, 22 aa, Artificial Sequence
  Description of Artificial Sequence: Synthetic peptide
SYVLTQPPSVSVAPGQTARITC

SEQ ID NO: 10293 - protein, 22 aa, Artificial Sequence
  Description of Artificial Sequence: Synthetic peptide
SYVLTQPPSVSVAPGQTARITC

SEQ ID NO: 10294 - protein, 22 aa, Artificial Sequence
  Description of Artificial Sequence: Synthetic peptide
SYVLTQPPSVSVAPGQTARITC

SEQ ID NO: 10295 - protein, 22 aa, Artificial Sequence
  Description of Artificial Sequence: Synthetic peptide
SYVLTQPPSVSVAPGKTARITC

SEQ ID NO: 10296 - protein, 22 aa, Artificial Sequence
  Description of Artificial Sequence: Synthetic peptide
SYVLTQPPSVSVAPGQTARITC

SEQ ID NO: 10297 - protein, 22 aa, Artificial Sequence
  Description of Artificial Sequence: Synthetic peptide
SYVLTQPPSVSVAPGQTARITC

SEQ ID NO: 10298 - protein, 30 aa, Artificial Sequence
  Description of Artificial Sequence: Synthetic polypeptide
EVQLVQSGAEVKKPGATVKISCKVSGYTFT

SEQ ID NO: 10299 - protein, 31 aa, Artificial Sequence
  Description of Artificial Sequence: Synthetic polypeptide
EVQLLEQSGPELVKPGASVKISCKASGYAFS

SEQ ID NO: 10300 - protein, 30 aa, Artificial Sequence; identical to SEQ ID NO: 4049
  Description of Artificial Sequence: Synthetic polypeptide

SEQ ID NO: 10301 - protein, 31 aa, Artificial Sequence
  Description of Artificial Sequence: Synthetic polypeptide
EVQLLEQSGPELVKPGASVKISCKASDYTFS

SEQ ID NO: 10302 - protein, 30 aa, Artificial Sequence; identical to SEQ ID NO: 4049
  Description of Artificial Sequence: Synthetic polypeptide

SEQ ID NO: 10303 - protein, 31 aa, Artificial Sequence; identical to SEQ ID NO: 10299
  Description of Artificial Sequence: Synthetic polypeptide

SEQ ID NO: 10304 - protein, 30 aa, Artificial Sequence; identical to SEQ ID NO: 3145
  Description of Artificial Sequence: Synthetic polypeptide

SEQ ID NO: 10305 - protein, 30 aa, Artificial Sequence; identical to SEQ ID NO: 3146
  Description of Artificial Sequence: Synthetic polypeptide

SEQ ID NO: 10306 - protein, 30 aa, Artificial Sequence; identical to SEQ ID NO: 3146
  Description of Artificial Sequence: Synthetic polypeptide

SEQ ID NO: 10307 - protein, 30 aa, Artificial Sequence; identical to SEQ ID NO: 3145
  Description of Artificial Sequence: Synthetic polypeptide

SEQ ID NO: 10308 - protein, 30 aa, Artificial Sequence; identical to SEQ ID NO: 3146
  Description of Artificial Sequence: Synthetic polypeptide

SEQ ID NO: 10309 - protein, 30 aa, Artificial Sequence
  Description of Artificial Sequence: Synthetic polypeptide
EVQLLESGAEVKKPGASVKVSCMASGYTFT

SEQ ID NO: 10310 - protein, 30 aa, Artificial Sequence; identical to SEQ ID NO: 3146
  Description of Artificial Sequence: Synthetic polypeptide

SEQ ID NO: 10311 - protein, 30 aa, Artificial Sequence; identical to SEQ ID NO: 4057
  Description of Artificial Sequence: Synthetic polypeptide

SEQ ID NO: 10312 - protein, 30 aa, Artificial Sequence
  Description of Artificial Sequence: Synthetic polypeptide
EVQLLEWGAGLLKPSETLSLTCAVYGGSFS

SEQ ID NO: 10313 - protein, 30 aa, Artificial Sequence; identical to SEQ ID NO: 10312
  Description of Artificial Sequence: Synthetic polypeptide

SEQ ID NO: 10314 - protein, 30 aa, Artificial Sequence; identical to SEQ ID NO: 10312
  Description of Artificial Sequence: Synthetic polypeptide

SEQ ID NO: 10315 - protein, 30 aa, Artificial Sequence; identical to SEQ ID NO: 10312
  Description of Artificial Sequence: Synthetic polypeptide

SEQ ID NO: 10316 - protein, 30 aa, Artificial Sequence; identical to SEQ ID NO: 10312
  Description of Artificial Sequence: Synthetic polypeptide

SEQ ID NO: 10317 - protein, 30 aa, Artificial Sequence; identical to SEQ ID NO: 10312
  Description of Artificial Sequence: Synthetic polypeptide

SEQ ID NO: 10318 - protein, 30 aa, Artificial Sequence; identical to SEQ ID NO: 10312
  Description of Artificial Sequence: Synthetic polypeptide

SEQ ID NO: 10319 - protein, 30 aa, Artificial Sequence; identical to SEQ ID NO: 10312
  Description of Artificial Sequence: Synthetic polypeptide

SEQ ID NO: 10320 - protein, 30 aa, Artificial Sequence
  Description of Artificial Sequence: Synthetic polypeptide
EVQLLEWGAGLLKPSETLSLTCAVYGGSLS

SEQ ID NO: 10321 - protein, 30 aa, Artificial Sequence
  Description of Artificial Sequence: Synthetic polypeptide
EVQLLEWGAGLLKPSETLSLTCGVYGGSFS

SEQ ID NO: 10322 - protein, 30 aa, Artificial Sequence; identical to SEQ ID NO: 779
  Description of Artificial Sequence: Synthetic polypeptide

SEQ ID NO: 10323 - protein, 30 aa, Artificial Sequence; identical to SEQ ID NO: 779
  Description of Artificial Sequence: Synthetic polypeptide

SEQ ID NO: 10324 - protein, 30 aa, Artificial Sequence; identical to SEQ ID NO: 779
  Description of Artificial Sequence: Synthetic polypeptide

SEQ ID NO: 10325 - protein, 30 aa, Artificial Sequence; identical to SEQ ID NO: 779
  Description of Artificial Sequence: Synthetic polypeptide

SEQ ID NO: 10326 - protein, 30 aa, Artificial Sequence; identical to SEQ ID NO: 779
  Description of Artificial Sequence: Synthetic polypeptide

SEQ ID NO: 10327 - protein, 30 aa, Artificial Sequence; identical to SEQ ID NO: 779
  Description of Artificial Sequence: Synthetic polypeptide

SEQ ID NO: 10328 - protein, 30 aa, Artificial Sequence; identical to SEQ ID NO: 853
  Description of Artificial Sequence: Synthetic polypeptide

SEQ ID NO: 10329 - protein, 30 aa, Artificial Sequence
  Description of Artificial Sequence: Synthetic polypeptide
EVQLLESGGGVVQPGRSLRLSCAASGFTFR

SEQ ID NO: 10330 - protein, 30 aa, Artificial Sequence; identical to SEQ ID NO: 784
  Description of Artificial Sequence: Synthetic polypeptide

SEQ ID NO: 10331 - protein, 30 aa, Artificial Sequence; identical to SEQ ID NO: 4057
  Description of Artificial Sequence: Synthetic polypeptide

SEQ ID NO: 10332 - protein, 30 aa, Artificial Sequence; identical to SEQ ID NO: 10312
  Description of Artificial Sequence: Synthetic polypeptide

SEQ ID NO: 10333 - protein, 30 aa, Artificial Sequence; identical to SEQ ID NO: 10312
  Description of Artificial Sequence: Synthetic polypeptide

SEQ ID NO: 10334 - protein, 30 aa, Artificial Sequence; identical to SEQ ID NO: 10321
  Description of Artificial Sequence: Synthetic polypeptide

SEQ ID NO: 10335 - protein, 30 aa, Artificial Sequence; identical to SEQ ID NO: 10312
  Description of Artificial Sequence: Synthetic polypeptide

SEQ ID NO: 10336 - protein, 30 aa, Artificial Sequence; identical to SEQ ID NO: 10312
  Description of Artificial Sequence: Synthetic polypeptide

SEQ ID NO: 10337 - protein, 30 aa, Artificial Sequence; identical to SEQ ID NO: 10312
  Description of Artificial Sequence: Synthetic polypeptide

SEQ ID NO: 10338 - protein, 30 aa, Artificial Sequence; identical to SEQ ID NO: 10312
  Description of Artificial Sequence: Synthetic polypeptide

SEQ ID NO: 10339 - protein, 30 aa, Artificial Sequence; identical to SEQ ID NO: 10312
  Description of Artificial Sequence: Synthetic polypeptide

SEQ ID NO: 10340 - protein, 30 aa, Artificial Sequence; identical to SEQ ID NO: 10312
  Description of Artificial Sequence: Synthetic polypeptide

SEQ ID NO: 10341 - protein, 30 aa, Artificial Sequence; identical to SEQ ID NO: 779
  Description of Artificial Sequence: Synthetic polypeptide

SEQ ID NO: 10342 - protein, 30 aa, Artificial Sequence; identical to SEQ ID NO: 779
  Description of Artificial Sequence: Synthetic polypeptide

SEQ ID NO: 10343 - protein, 30 aa, Artificial Sequence; identical to SEQ ID NO: 779
  Description of Artificial Sequence: Synthetic polypeptide

SEQ ID NO: 10344 - protein, 30 aa, Artificial Sequence
  Description of Artificial Sequence: Synthetic polypeptide
EVQLLESGGGLVQPGGSLRLSCAASGFTFT

SEQ ID NO: 10345 - protein, 30 aa, Artificial Sequence; identical to SEQ ID NO: 779
  Description of Artificial Sequence: Synthetic polypeptide

SEQ ID NO: 10346 - protein, 30 aa, Artificial Sequence; identical to SEQ ID NO: 779
  Description of Artificial Sequence: Synthetic polypeptide

SEQ ID NO: 10347 - protein, 30 aa, Artificial Sequence; identical to SEQ ID NO: 779
  Description of Artificial Sequence: Synthetic polypeptide

SEQ ID NO: 10348 - protein, 30 aa, Artificial Sequence; identical to SEQ ID NO: 779
  Description of Artificial Sequence: Synthetic polypeptide

SEQ ID NO: 10349 - protein, 30 aa, Artificial Sequence
  Description of Artificial Sequence: Synthetic polypeptide
EVQLLESGGGLVQPGGSLRLSCAASGFTLS

SEQ ID NO: 10350 - protein, 30 aa, Artificial Sequence; identical to SEQ ID NO: 779
  Description of Artificial Sequence: Synthetic polypeptide

SEQ ID NO: 10351 - protein, 30 aa, Artificial Sequence; identical to SEQ ID NO: 779
  Description of Artificial Sequence: Synthetic polypeptide

SEQ ID NO: 10352 - protein, 30 aa, Artificial Sequence; identical to SEQ ID NO: 779
  Description of Artificial Sequence: Synthetic polypeptide

SEQ ID NO: 10353 - protein, 30 aa, Artificial Sequence; identical to SEQ ID NO: 779
  Description of Artificial Sequence: Synthetic polypeptide

SEQ ID NO: 10354 - protein, 30 aa, Artificial Sequence; identical to SEQ ID NO: 858
  Description of Artificial Sequence: Synthetic polypeptide

SEQ ID NO: 10355 - protein, 30 aa, Artificial Sequence; identical to SEQ ID NO: 3164
  Description of Artificial Sequence: Synthetic polypeptide

SEQ ID NO: 10356 - protein, 30 aa, Artificial Sequence
  Description of Artificial Sequence: Synthetic polypeptide
EVQLLESGPGLVKPSQTLSLTCTVSGGSIS

SEQ ID NO: 10357 - protein, 30 aa, Artificial Sequence; identical to SEQ ID NO: 3164
  Description of Artificial Sequence: Synthetic polypeptide

SEQ ID NO: 10358 - protein, 30 aa, Artificial Sequence
  Description of Artificial Sequence: Synthetic polypeptide
EVQLLESGPGLVKPSQTLSLTCTVSGGAIS

SEQ ID NO: 10359 - protein, 30 aa, Artificial Sequence; identical to SEQ ID NO: 10358
  Description of Artificial Sequence: Synthetic polypeptide

SEQ ID NO: 10360 - protein, 30 aa, Artificial Sequence; identical to SEQ ID NO: 10358
  Description of Artificial Sequence: Synthetic polypeptide

SEQ ID NO: 10361 - protein, 30 aa, Artificial Sequence; identical to SEQ ID NO: 10358
  Description of Artificial Sequence: Synthetic polypeptide

SEQ ID NO: 10362 - protein, 30 aa, Artificial Sequence; identical to SEQ ID NO: 3164
  Description of Artificial Sequence: Synthetic polypeptide

SEQ ID NO: 10363 - protein, 30 aa, Artificial Sequence; identical to SEQ ID NO: 3164
  Description of Artificial Sequence: Synthetic polypeptide

SEQ ID NO: 10364 - protein, 30 aa, Artificial Sequence; identical to SEQ ID NO: 10358
  Description of Artificial Sequence: Synthetic polypeptide

SEQ ID NO: 10365 - protein, 30 aa, Artificial Sequence; identical to SEQ ID NO: 10358
  Description of Artificial Sequence: Synthetic polypeptide

SEQ ID NO: 10366 - protein, 30 aa, Artificial Sequence; identical to SEQ ID NO: 3164
  Description of Artificial Sequence: Synthetic polypeptide

SEQ ID NO: 10367 - protein, 30 aa, Artificial Sequence; identical to SEQ ID NO: 10358
  Description of Artificial Sequence: Synthetic polypeptide

SEQ ID NO: 10368 - protein, 30 aa, Artificial Sequence; identical to SEQ ID NO: 3164
  Description of Artificial Sequence: Synthetic polypeptide

SEQ ID NO: 10369 - protein, 30 aa, Artificial Sequence; identical to SEQ ID NO: 3164
  Description of Artificial Sequence: Synthetic polypeptide

SEQ ID NO: 10370 - protein, 30 aa, Artificial Sequence; identical to SEQ ID NO: 3164
  Description of Artificial Sequence: Synthetic polypeptide

SEQ ID NO: 10371 - protein, 30 aa, Artificial Sequence; identical to SEQ ID NO: 3164
  Description of Artificial Sequence: Synthetic polypeptide

SEQ ID NO: 10372 - protein, 30 aa, Artificial Sequence; identical to SEQ ID NO: 3164
  Description of Artificial Sequence: Synthetic polypeptide

SEQ ID NO: 10373 - protein, 30 aa, Artificial Sequence; identical to SEQ ID NO: 779
  Description of Artificial Sequence: Synthetic polypeptide

SEQ ID NO: 10374 - protein, 30 aa, Artificial Sequence; identical to SEQ ID NO: 779
  Description of Artificial Sequence: Synthetic polypeptide

SEQ ID NO: 10375 - protein, 30 aa, Artificial Sequence; identical to SEQ ID NO: 853
  Description of Artificial Sequence: Synthetic polypeptide

SEQ ID NO: 10376 - protein, 30 aa, Artificial Sequence; identical to SEQ ID NO: 784
  Description of Artificial Sequence: Synthetic polypeptide

SEQ ID NO: 10377 - protein, 30 aa, Artificial Sequence; identical to SEQ ID NO: 784
  Description of Artificial Sequence: Synthetic polypeptide

SEQ ID NO: 10378 - protein, 30 aa, Artificial Sequence; identical to SEQ ID NO: 3145
  Description of Artificial Sequence: Synthetic polypeptide

SEQ ID NO: 10379 - protein, 30 aa, Artificial Sequence; identical to SEQ ID NO: 3146
  Description of Artificial Sequence: Synthetic polypeptide

SEQ ID NO: 10380 - protein, 30 aa, Artificial Sequence; identical to SEQ ID NO: 3146
  Description of Artificial Sequence: Synthetic polypeptide

SEQ ID NO: 10381 - protein, 30 aa, Artificial Sequence; identical to SEQ ID NO: 3146
  Description of Artificial Sequence: Synthetic polypeptide

SEQ ID NO: 10382 - protein, 30 aa, Artificial Sequence; identical to SEQ ID NO: 3146
  Description of Artificial Sequence: Synthetic polypeptide

SEQ ID NO: 10383 - protein, 30 aa, Artificial Sequence; identical to SEQ ID NO: 3146
  Description of Artificial Sequence: Synthetic polypeptide

SEQ ID NO: 10384 - protein, 30 aa, Artificial Sequence; identical to SEQ ID NO: 832
  Description of Artificial Sequence: Synthetic polypeptide

SEQ ID NO: 10385 - protein, 30 aa, Artificial Sequence; identical to SEQ ID NO: 787
  Description of Artificial Sequence: Synthetic polypeptide

SEQ ID NO: 10386 - protein, 30 aa, Artificial Sequence; identical to SEQ ID NO: 853
  Description of Artificial Sequence: Synthetic polypeptide

SEQ ID NO: 10387 - protein, 30 aa, Artificial Sequence; identical to SEQ ID NO: 784
  Description of Artificial Sequence: Synthetic polypeptide

SEQ ID NO: 10388 - protein, 30 aa, Artificial Sequence; identical to SEQ ID NO: 784
  Description of Artificial Sequence: Synthetic polypeptide

SEQ ID NO: 10389 - protein, 30 aa, Artificial Sequence; identical to SEQ ID NO: 851
  Description of Artificial Sequence: Synthetic polypeptide

SEQ ID NO: 10390 - protein, 30 aa, Artificial Sequence; identical to SEQ ID NO: 3160
  Description of Artificial Sequence: Synthetic polypeptide

SEQ ID NO: 10391 - protein, 30 aa, Artificial Sequence; identical to SEQ ID NO: 3160
  Description of Artificial Sequence: Synthetic polypeptide

SEQ ID NO: 10392 - protein, 30 aa, Artificial Sequence; identical to SEQ ID NO: 3160
  Description of Artificial Sequence: Synthetic polypeptide

SEQ ID NO: 10393 - protein, 30 aa, Artificial Sequence; identical to SEQ ID NO: 852
  Description of Artificial Sequence: Synthetic polypeptide

SEQ ID NO: 10394 - protein, 30 aa, Artificial Sequence; identical to SEQ ID NO: 5230
  Description of Artificial Sequence: Synthetic polypeptide

SEQ ID NO: 10395 - protein, 30 aa, Artificial Sequence
  Description of Artificial Sequence: Synthetic polypeptide
EVQLLESGPGQVKPSQTLSLTCAISGDSVS

SEQ ID NO: 10396 - protein, 30 aa, Artificial Sequence
  Description of Artificial Sequence: Synthetic polypeptide
QVQLQESGPGLVKPSETLSLTCAVSGYSIS

SEQ ID NO: 10397 - protein, 30 aa, Artificial Sequence
  Description of Artificial Sequence: Synthetic polypeptide
EVQLLESGPGLVKPSETLSLTCIVSGVSIS

SEQ ID NO: 10398 - protein, 30 aa, Artificial Sequence; identical to SEQ ID NO: 830
  Description of Artificial Sequence: Synthetic polypeptide

SEQ ID NO: 10399 - protein, 30 aa, Artificial Sequence
  Description of Artificial Sequence: Synthetic polypeptide
EVQLLESGPALVKPTQTLTLTCTFSGFSFT

SEQ ID NO: 10400 - protein, 30 aa, Artificial Sequence
  Description of Artificial Sequence: Synthetic polypeptide
EVQLLESGPALVKPTQTLTLSCSFSGFSLS

SEQ ID NO: 10401 - protein, 30 aa, Artificial Sequence; identical to SEQ ID NO: 10399
  Description of Artificial Sequence: Synthetic polypeptide

SEQ ID NO: 10402 - protein, 30 aa, Artificial Sequence; identical to SEQ ID NO: 779
  Description of Artificial Sequence: Synthetic polypeptide

SEQ ID NO: 10403 - protein, 30 aa, Artificial Sequence; identical to SEQ ID NO: 787
  Description of Artificial Sequence: Synthetic polypeptide

SEQ ID NO: 10404 - protein, 30 aa, Artificial Sequence; identical to SEQ ID NO: 851
  Description of Artificial Sequence: Synthetic polypeptide

SEQ ID NO: 10405 - protein, 30 aa, Artificial Sequence
  Description of Artificial Sequence: Synthetic polypeptide
EVQLLESGPGLVKPSETLSLTCIVSGGSIS

SEQ ID NO: 10406 - protein, 30 aa, Artificial Sequence; identical to SEQ ID NO: 842
  Description of Artificial Sequence: Synthetic polypeptide

SEQ ID NO: 10407 - protein, 30 aa, Artificial Sequence
  Description of Artificial Sequence: Synthetic polypeptide
EVQLLESGPVLVKPTQTLTLTCTFSGFSFT

SEQ ID NO: 10408 - protein, 30 aa, Artificial Sequence; identical to SEQ ID NO: 10407
  Description of Artificial Sequence: Synthetic polypeptide

SEQ ID NO: 10409 - protein, 30 aa, Artificial Sequence
  Description of Artificial Sequence: Synthetic polypeptide
EVQLLESGPTLVKPTQTLTLTCTFSGFSFT

SEQ ID NO: 10410 - protein, 30 aa, Artificial Sequence; identical to SEQ ID NO: 3162
  Description of Artificial Sequence: Synthetic polypeptide

SEQ ID NO: 10411 - protein, 30 aa, Artificial Sequence; identical to SEQ ID NO: 3162
  Description of Artificial Sequence: Synthetic polypeptide

SEQ ID NO: 10412 - protein, 30 aa, Artificial Sequence; identical to SEQ ID NO: 3162
  Description of Artificial Sequence: Synthetic polypeptide

SEQ ID NO: 10413 - protein, 30 aa, Artificial Sequence; identical to SEQ ID NO: 844
  Description of Artificial Sequence: Synthetic polypeptide

SEQ ID NO: 10414 - protein, 30 aa, Artificial Sequence; identical to SEQ ID NO: 845
  Description of Artificial Sequence: Synthetic polypeptide

SEQ ID NO: 10415 - protein, 30 aa, Artificial Sequence; identical to SEQ ID NO: 844
  Description of Artificial Sequence: Synthetic polypeptide

SEQ ID NO: 10416 - protein, 30 aa, Artificial Sequence; identical to SEQ ID NO: 845
  Description of Artificial Sequence: Synthetic polypeptide

SEQ ID NO: 10417 - protein, 30 aa, Artificial Sequence; identical to SEQ ID NO: 779
  Description of Artificial Sequence: Synthetic polypeptide

SEQ ID NO: 10418 - protein, 30 aa, Artificial Sequence; identical to SEQ ID NO: 779
  Description of Artificial Sequence: Synthetic polypeptide

SEQ ID NO: 10419 - protein, 30 aa, Artificial Sequence; identical to SEQ ID NO: 779
  Description of Artificial Sequence: Synthetic polypeptide

SEQ ID NO: 10420 - protein, 30 aa, Artificial Sequence; identical to SEQ ID NO: 858
  Description of Artificial Sequence: Synthetic polypeptide

SEQ ID NO: 10421 - protein, 30 aa, Artificial Sequence
  Description of Artificial Sequence: Synthetic polypeptide
EVQLLESGPGLVKPSETLSLTCTVSGGAIS

SEQ ID NO: 10422 - protein, 30 aa, Artificial Sequence; identical to SEQ ID NO: 3164
  Description of Artificial Sequence: Synthetic polypeptide

SEQ ID NO: 10423 - protein, 30 aa, Artificial Sequence; identical to SEQ ID NO: 10356
  Description of Artificial Sequence: Synthetic polypeptide

SEQ ID NO: 10424 - protein, 30 aa, Artificial Sequence; identical to SEQ ID NO: 3164
  Description of Artificial Sequence: Synthetic polypeptide

SEQ ID NO: 10425 - protein, 30 aa, Artificial Sequence; identical to SEQ ID NO: 10356
  Description of Artificial Sequence: Synthetic polypeptide

SEQ ID NO: 10426 - protein, 30 aa, Artificial Sequence; identical to SEQ ID NO: 859
  Description of Artificial Sequence: Synthetic polypeptide

SEQ ID NO: 10427 - protein, 30 aa, Artificial Sequence; identical to SEQ ID NO: 832
  Description of Artificial Sequence: Synthetic polypeptide

SEQ ID NO: 10428 - protein, 30 aa, Artificial Sequence; identical to SEQ ID NO: 787
  Description of Artificial Sequence: Synthetic polypeptide

SEQ ID NO: 10429 - protein, 30 aa, Artificial Sequence; identical to SEQ ID NO: 779
  Description of Artificial Sequence: Synthetic polypeptide

SEQ ID NO: 10430 - protein, 30 aa, Artificial Sequence; identical to SEQ ID NO: 787
  Description of Artificial Sequence: Synthetic polypeptide

SEQ ID NO: 10431 - protein, 30 aa, Artificial Sequence; identical to SEQ ID NO: 787
  Description of Artificial Sequence: Synthetic polypeptide

SEQ ID NO: 10432 - protein, 30 aa, Artificial Sequence; identical to SEQ ID NO: 779
  Description of Artificial Sequence: Synthetic polypeptide

SEQ ID NO: 10433 - protein, 30 aa, Artificial Sequence; identical to SEQ ID NO: 787
  Description of Artificial Sequence: Synthetic polypeptide

SEQ ID NO: 10434 - protein, 30 aa, Artificial Sequence; identical to SEQ ID NO: 779
  Description of Artificial Sequence: Synthetic polypeptide

SEQ ID NO: 10435 - protein, 30 aa, Artificial Sequence; identical to SEQ ID NO: 779
  Description of Artificial Sequence: Synthetic polypeptide

SEQ ID NO: 10436 - protein, 30 aa, Artificial Sequence; identical to SEQ ID NO: 779
  Description of Artificial Sequence: Synthetic polypeptide

SEQ ID NO: 10437 - protein, 30 aa, Artificial Sequence; identical to SEQ ID NO: 787
  Description of Artificial Sequence: Synthetic polypeptide

SEQ ID NO: 10438 - protein, 30 aa, Artificial Sequence; identical to SEQ ID NO: 779
  Description of Artificial Sequence: Synthetic polypeptide

SEQ ID NO: 10439 - protein, 30 aa, Artificial Sequence; identical to SEQ ID NO: 787
  Description of Artificial Sequence: Synthetic polypeptide

SEQ ID NO: 10440 - protein, 30 aa, Artificial Sequence; identical to SEQ ID NO: 779
  Description of Artificial Sequence: Synthetic polypeptide

SEQ ID NO: 10441 - protein, 30 aa, Artificial Sequence; identical to SEQ ID NO: 779
  Description of Artificial Sequence: Synthetic polypeptide

SEQ ID NO: 10442 - protein, 30 aa, Artificial Sequence; identical to SEQ ID NO: 787
  Description of Artificial Sequence: Synthetic polypeptide

SEQ ID NO: 10443 - protein, 30 aa, Artificial Sequence; identical to SEQ ID NO: 779
  Description of Artificial Sequence: Synthetic polypeptide

SEQ ID NO: 10444 - protein, 30 aa, Artificial Sequence; identical to SEQ ID NO: 833
  Description of Artificial Sequence: Synthetic polypeptide

SEQ ID NO: 10445 - protein, 30 aa, Artificial Sequence; identical to SEQ ID NO: 833
  Description of Artificial Sequence: Synthetic polypeptide

SEQ ID NO: 10446 - protein, 30 aa, Artificial Sequence; identical to SEQ ID NO: 833
  Description of Artificial Sequence: Synthetic polypeptide

SEQ ID NO: 10447 - protein, 30 aa, Artificial Sequence; identical to SEQ ID NO: 833
  Description of Artificial Sequence: Synthetic polypeptide

SEQ ID NO: 10448 - protein, 30 aa, Artificial Sequence; identical to SEQ ID NO: 832
  Description of Artificial Sequence: Synthetic polypeptide

SEQ ID NO: 10449 - protein, 30 aa, Artificial Sequence; identical to SEQ ID NO: 833
  Description of Artificial Sequence: Synthetic polypeptide

SEQ ID NO: 10450 - protein, 30 aa, Artificial Sequence; identical to SEQ ID NO: 833
  Description of Artificial Sequence: Synthetic polypeptide

SEQ ID NO: 10451 - protein, 30 aa, Artificial Sequence; identical to SEQ ID NO: 851
  Description of Artificial Sequence: Synthetic polypeptide

SEQ ID NO: 10452 - protein, 30 aa, Artificial Sequence
  Description of Artificial Sequence: Synthetic polypeptide
EVQLLESGPGLVKPSETLTLTCTVSGGSIS

SEQ ID NO: 10453 - protein, 30 aa, Artificial Sequence
  Description of Artificial Sequence: Synthetic polypeptide
EVQLLESGPGLVKPTETLSLTCTVSGGSIS

SEQ ID NO: 10454 - protein, 30 aa, Artificial Sequence
  Description of Artificial Sequence: Synthetic polypeptide
EVQLLESGPGLVKPSETLSLTCTVSGGSIS

SEQ ID NO: 10455 - protein, 30 aa, Artificial Sequence; identical to SEQ ID NO: 779
  Description of Artificial Sequence: Synthetic polypeptide

SEQ ID NO: 10456 - protein, 30 aa, Artificial Sequence; identical to SEQ ID NO: 779
  Description of Artificial Sequence: Synthetic polypeptide

SEQ ID NO: 10457 - protein, 30 aa, Artificial Sequence; identical to SEQ ID NO: 779
  Description of Artificial Sequence: Synthetic polypeptide

SEQ ID NO: 10458 - protein, 30 aa, Artificial Sequence; identical to SEQ ID NO: 779
  Description of Artificial Sequence: Synthetic polypeptide

SEQ ID NO: 10459 - protein, 30 aa, Artificial Sequence; identical to SEQ ID NO: 779
  Description of Artificial Sequence: Synthetic polypeptide

SEQ ID NO: 10460 - protein, 30 aa, Artificial Sequence; identical to SEQ ID NO: 779
  Description of Artificial Sequence: Synthetic polypeptide

SEQ ID NO: 10461 - protein, 30 aa, Artificial Sequence; identical to SEQ ID NO: 779
  Description of Artificial Sequence: Synthetic polypeptide

SEQ ID NO: 10462 - protein, 30 aa, Artificial Sequence; identical to SEQ ID NO: 779
  Description of Artificial Sequence: Synthetic polypeptide

SEQ ID NO: 10463 - protein, 30 aa, Artificial Sequence; identical to SEQ ID NO: 779
  Description of Artificial Sequence: Synthetic polypeptide

SEQ ID NO: 10464 - protein, 30 aa, Artificial Sequence; identical to SEQ ID NO: 779
  Description of Artificial Sequence: Synthetic polypeptide

SEQ ID NO: 10465 - protein, 30 aa, Artificial Sequence; identical to SEQ ID NO: 779
  Description of Artificial Sequence: Synthetic polypeptide

SEQ ID NO: 10466 - protein, 30 aa, Artificial Sequence; identical to SEQ ID NO: 779
  Description of Artificial Sequence: Synthetic polypeptide

SEQ ID NO: 10467 - protein, 30 aa, Artificial Sequence
  Description of Artificial Sequence: Synthetic polypeptide
EVQLLESGGDLVQPGGSLRLSCAASGFTFS

SEQ ID NO: 10468 - protein, 30 aa, Artificial Sequence; identical to SEQ ID NO: 779
  Description of Artificial Sequence: Synthetic polypeptide

SEQ ID NO: 10469 - protein, 30 aa, Artificial Sequence; identical to SEQ ID NO: 779
  Description of Artificial Sequence: Synthetic polypeptide

SEQ ID NO: 10470 - protein, 30 aa, Artificial Sequence; identical to SEQ ID NO: 779
  Description of Artificial Sequence: Synthetic polypeptide

SEQ ID NO: 10471 - protein, 30 aa, Artificial Sequence
  Description of Artificial Sequence: Synthetic polypeptide
EVQLLESGGDLVQPGGSLRLSCAASGITFS

SEQ ID NO: 10472 - protein, 30 aa, Artificial Sequence; identical to SEQ ID NO: 10467
  Description of Artificial Sequence: Synthetic polypeptide

SEQ ID NO: 10473 - protein, 30 aa, Artificial Sequence; identical to SEQ ID NO: 779
  Description of Artificial Sequence: Synthetic polypeptide

SEQ ID NO: 10474 - protein, 30 aa, Artificial Sequence; identical to SEQ ID NO: 10467
  Description of Artificial Sequence: Synthetic polypeptide

SEQ ID NO: 10475 - protein, 30 aa, Artificial Sequence; identical to SEQ ID NO: 779
  Description of Artificial Sequence: Synthetic polypeptide

SEQ ID NO: 10476 - protein, 30 aa, Artificial Sequence
  Description of Artificial Sequence: Synthetic polypeptide
EVQLLESGGDLVQPGGSLRLSCAASGFTFG

SEQ ID NO: 10477 - protein, 30 aa, Artificial Sequence; identical to SEQ ID NO: 779
  Description of Artificial Sequence: Synthetic polypeptide

SEQ ID NO: 10478 - protein, 30 aa, Artificial Sequence; identical to SEQ ID NO: 779
  Description of Artificial Sequence: Synthetic polypeptide

SEQ ID NO: 10479 - protein, 30 aa, Artificial Sequence; identical to SEQ ID NO: 779
  Description of Artificial Sequence: Synthetic polypeptide

SEQ ID NO: 10480 - protein, 30 aa, Artificial Sequence; identical to SEQ ID NO: 10467
  Description of Artificial Sequence: Synthetic polypeptide

SEQ ID NO: 10481 - protein, 30 aa, Artificial Sequence; identical to SEQ ID NO: 779
  Description of Artificial Sequence: Synthetic polypeptide

SEQ ID NO: 10482 - protein, 30 aa, Artificial Sequence; identical to SEQ ID NO: 779
  Description of Artificial Sequence: Synthetic polypeptide

SEQ ID NO: 10483 - protein, 30 aa, Artificial Sequence; identical to SEQ ID NO: 10467
  Description of Artificial Sequence: Synthetic polypeptide

SEQ ID NO: 10484 - protein, 30 aa, Artificial Sequence; identical to SEQ ID NO: 779
  Description of Artificial Sequence: Synthetic polypeptide

SEQ ID NO: 10485 - protein, 30 aa, Artificial Sequence; identical to SEQ ID NO: 779
  Description of Artificial Sequence: Synthetic polypeptide

SEQ ID NO: 10486 - protein, 30 aa, Artificial Sequence; identical to SEQ ID NO: 779
  Description of Artificial Sequence: Synthetic polypeptide

SEQ ID NO: 10487 - protein, 30 aa, Artificial Sequence; identical to SEQ ID NO: 779
  Description of Artificial Sequence: Synthetic polypeptide

SEQ ID NO: 10488 - protein, 30 aa, Artificial Sequence; identical to SEQ ID NO: 779
  Description of Artificial Sequence: Synthetic polypeptide

SEQ ID NO: 10489 - protein, 30 aa, Artificial Sequence; identical to SEQ ID NO: 779
  Description of Artificial Sequence: Synthetic polypeptide

SEQ ID NO: 10490 - protein, 30 aa, Artificial Sequence; identical to SEQ ID NO: 779
  Description of Artificial Sequence: Synthetic polypeptide

SEQ ID NO: 10491 - protein, 30 aa, Artificial Sequence; identical to SEQ ID NO: 779
  Description of Artificial Sequence: Synthetic polypeptide

SEQ ID NO: 10492 - protein, 30 aa, Artificial Sequence; identical to SEQ ID NO: 779
  Description of Artificial Sequence: Synthetic polypeptide

SEQ ID NO: 10493 - protein, 30 aa, Artificial Sequence; identical to SEQ ID NO: 779
  Description of Artificial Sequence: Synthetic polypeptide

SEQ ID NO: 10494 - protein, 30 aa, Artificial Sequence; identical to SEQ ID NO: 779
  Description of Artificial Sequence: Synthetic polypeptide

SEQ ID NO: 10495 - protein, 30 aa, Artificial Sequence; identical to SEQ ID NO: 787
  Description of Artificial Sequence: Synthetic polypeptide

SEQ ID NO: 10496 - protein, 30 aa, Artificial Sequence; identical to SEQ ID NO: 779
  Description of Artificial Sequence: Synthetic polypeptide

SEQ ID NO: 10497 - protein, 30 aa, Artificial Sequence; identical to SEQ ID NO: 779
  Description of Artificial Sequence: Synthetic polypeptide

SEQ ID NO: 10498 - protein, 30 aa, Artificial Sequence; identical to SEQ ID NO: 779
  Description of Artificial Sequence: Synthetic polypeptide

SEQ ID NO: 10499 - protein, 30 aa, Artificial Sequence; identical to SEQ ID NO: 784
  Description of Artificial Sequence: Synthetic polypeptide

SEQ ID NO: 10500 - protein, 30 aa, Artificial Sequence; identical to SEQ ID NO: 779
  Description of Artificial Sequence: Synthetic polypeptide

SEQ ID NO: 10501 - protein, 30 aa, Artificial Sequence; identical to SEQ ID NO: 779
  Description of Artificial Sequence: Synthetic polypeptide

SEQ ID NO: 10502 - protein, 30 aa, Artificial Sequence; identical to SEQ ID NO: 779
  Description of Artificial Sequence: Synthetic polypeptide

SEQ ID NO: 10503 - protein, 30 aa, Artificial Sequence; identical to SEQ ID NO: 779
  Description of Artificial Sequence: Synthetic polypeptide

SEQ ID NO: 10504 - protein, 30 aa, Artificial Sequence; identical to SEQ ID NO: 779
  Description of Artificial Sequence: Synthetic polypeptide

SEQ ID NO: 10505 - protein, 30 aa, Artificial Sequence; identical to SEQ ID NO: 779
  Description of Artificial Sequence: Synthetic polypeptide

SEQ ID NO: 10506 - protein, 30 aa, Artificial Sequence; identical to SEQ ID NO: 779
  Description of Artificial Sequence: Synthetic polypeptide

SEQ ID NO: 10507 - protein, 30 aa, Artificial Sequence; identical to SEQ ID NO: 779
  Description of Artificial Sequence: Synthetic polypeptide

SEQ ID NO: 10508 - protein, 30 aa, Artificial Sequence; identical to SEQ ID NO: 779
  Description of Artificial Sequence: Synthetic polypeptide

SEQ ID NO: 10509 - protein, 30 aa, Artificial Sequence; identical to SEQ ID NO: 779
  Description of Artificial Sequence: Synthetic polypeptide

SEQ ID NO: 10510 - protein, 30 aa, Artificial Sequence; identical to SEQ ID NO: 779
  Description of Artificial Sequence: Synthetic polypeptide

SEQ ID NO: 10511 - protein, 30 aa, Artificial Sequence; identical to SEQ ID NO: 779
  Description of Artificial Sequence: Synthetic polypeptide

SEQ ID NO: 10512 - protein, 30 aa, Artificial Sequence; identical to SEQ ID NO: 779
  Description of Artificial Sequence: Synthetic polypeptide

SEQ ID NO: 10513 - protein, 30 aa, Artificial Sequence; identical to SEQ ID NO: 779
  Description of Artificial Sequence: Synthetic polypeptide

SEQ ID NO: 10514 - protein, 30 aa, Artificial Sequence; identical to SEQ ID NO: 779
  Description of Artificial Sequence: Synthetic polypeptide

SEQ ID NO: 10515 - protein, 30 aa, Artificial Sequence; identical to SEQ ID NO: 853
  Description of Artificial Sequence: Synthetic polypeptide

SEQ ID NO: 10516 - protein, 30 aa, Artificial Sequence; identical to SEQ ID NO: 784
  Description of Artificial Sequence: Synthetic polypeptide

SEQ ID NO: 10517 - protein, 30 aa, Artificial Sequence; identical to SEQ ID NO: 853
  Description of Artificial Sequence: Synthetic polypeptide

SEQ ID NO: 10518 - protein, 30 aa, Artificial Sequence; identical to SEQ ID NO: 853
  Description of Artificial Sequence: Synthetic polypeptide

SEQ ID NO: 10519 - protein, 30 aa, Artificial Sequence; identical to SEQ ID NO: 3145
  Description of Artificial Sequence: Synthetic polypeptide

SEQ ID NO: 10520 - protein, 30 aa, Artificial Sequence; identical to SEQ ID NO: 3146
  Description of Artificial Sequence: Synthetic polypeptide

SEQ ID NO: 10521 - protein, 30 aa, Artificial Sequence; identical to SEQ ID NO: 3146
  Description of Artificial Sequence: Synthetic polypeptide

SEQ ID NO: 10522 - protein, 30 aa, Artificial Sequence; identical to SEQ ID NO: 856
  Description of Artificial Sequence: Synthetic polypeptide

SEQ ID NO: 10523 - protein, 30 aa, Artificial Sequence; identical to SEQ ID NO: 787
  Description of Artificial Sequence: Synthetic polypeptide

SEQ ID NO: 10524 - protein, 30 aa, Artificial Sequence; identical to SEQ ID NO: 856
  Description of Artificial Sequence: Synthetic polypeptide

SEQ ID NO: 10525 - protein, 17 aa, Artificial Sequence
  Description of Artificial Sequence: Synthetic peptide
KSSQSVLYSSNNKNYLA

SEQ ID NO: 10526 - protein, 17 aa, Artificial Sequence
  Description of Artificial Sequence: Synthetic peptide
KSSQSLLYSSNQKNYLA

SEQ ID NO: 10527 - protein, 17 aa, Artificial Sequence
  Description of Artificial Sequence: Synthetic peptide
KSSQSVLYSSNNKNYLA

SEQ ID NO: 10528 - protein, 17 aa, Artificial Sequence
  Description of Artificial Sequence: Synthetic peptide
KSSQSVLYSSNNKNYLA

SEQ ID NO: 10529 - protein, 11 aa, Artificial Sequence
  Description of Artificial Sequence: Synthetic peptide
RASQSIGSSLH

SEQ ID NO: 10530 - protein, 10 aa, Artificial Sequence
  Description of Artificial Sequence: Synthetic peptide
SASSNVNYIH

SEQ ID NO: 10531 - protein, 11 aa, Artificial Sequence
  Description of Artificial Sequence: Synthetic peptide
RASQGIRNDLG

SEQ ID NO: 10532 - protein, 11 aa, Artificial Sequence
  Description of Artificial Sequence: Synthetic peptide
RASGNIHNYLA

SEQ ID NO: 10533 - protein, 16 aa, Artificial Sequence
  Description of Artificial Sequence: Synthetic peptide
RSSQSLLHSNGYNYLD

SEQ ID NO: 10534 - protein, 16 aa, Artificial Sequence
  Description of Artificial Sequence: Synthetic peptide
RSSQSLLYSNGYNYVD

SEQ ID NO: 10535 - protein, 16 aa, Artificial Sequence
  Description of Artificial Sequence: Synthetic peptide
RSSQSLLHRNGYNYLD

SEQ ID NO: 10536 - protein, 16 aa, Artificial Sequence
  Description of Artificial Sequence: Synthetic peptide
RSSQSLLHSNGYNYLD

SEQ ID NO: 10537 - protein, 16 aa, Artificial Sequence
  Description of Artificial Sequence: Synthetic peptide
RSSQSLLYSNGYHYLD

SEQ ID NO: 10538 - protein, 16 aa, Artificial Sequence
  Description of Artificial Sequence: Synthetic peptide
RSSQRLLFSNGYHYLD

SEQ ID NO: 10539 - protein, 16 aa, Artificial Sequence
  Description of Artificial Sequence: Synthetic peptide
RSSQSLLYSNGYNYLD

SEQ ID NO: 10540 - protein, 16 aa, Artificial Sequence
  Description of Artificial Sequence: Synthetic peptide
RSSQSLLYSNGYNYLD

SEQ ID NO: 10541 - protein, 16 aa, Artificial Sequence
  Description of Artificial Sequence: Synthetic peptide
RSSQSLLHSTGYNYLD

SEQ ID NO: 10542 - protein, 16 aa, Artificial Sequence
  Description of Artificial Sequence: Synthetic peptide
RSSQSLLHRNGYHYLD

SEQ ID NO: 10543 - protein, 16 aa, Artificial Sequence
  Description of Artificial Sequence: Synthetic peptide
RSSQSLLHRNGYNYLD

SEQ ID NO: 10544 - protein, 16 aa, Artificial Sequence
  Description of Artificial Sequence: Synthetic peptide
RSSQSLLHSTGYNYLD

SEQ ID NO: 10545 - protein, 17 aa, Artificial Sequence
  Description of Artificial Sequence: Synthetic peptide
RSSQSLLDSDDGNTYLD

SEQ ID NO: 10546 - protein, 16 aa, Artificial Sequence
  Description of Artificial Sequence: Synthetic peptide
RSSQSLLYSNGYNYLD

SEQ ID NO: 10547 - protein, 16 aa, Artificial Sequence
  Description of Artificial Sequence: Synthetic peptide
RSSQSLLHRNGYNYLD

SEQ ID NO: 10548 - protein, 16 aa, Artificial Sequence
  Description of Artificial Sequence: Synthetic peptide
RSSQSLLHSNGYNYLD

SEQ ID NO: 10549 - protein, 16 aa, Artificial Sequence
  Description of Artificial Sequence: Synthetic peptide
RSSQSLLHRNGYNYLD

SEQ ID NO: 10550 - protein, 16 aa, Artificial Sequence
  Description of Artificial Sequence: Synthetic peptide
RSSQSLLHRNGYNYLD

SEQ ID NO: 10551 - protein, 16 aa, Artificial Sequence
  Description of Artificial Sequence: Synthetic peptide
RSSQSLLHRNGYNYLD

SEQ ID NO: 10552 - protein, 16 aa, Artificial Sequence
  Description of Artificial Sequence: Synthetic peptide
RSSQSLLHRSGYNYLD

SEQ ID NO: 10553 - protein, 12 aa, Artificial Sequence
  Description of Artificial Sequence: Synthetic peptide
RASQSVSSSYLA

SEQ ID NO: 10554 - protein, 12 aa, Artificial Sequence
  Description of Artificial Sequence: Synthetic peptide
RASQSVSSSYLA

SEQ ID NO: 10555 - protein, 12 aa, Artificial Sequence
  Description of Artificial Sequence: Synthetic peptide
RASQSVSSGYLA

SEQ ID NO: 10556 - protein, 12 aa, Artificial Sequence
  Description of Artificial Sequence: Synthetic peptide
RASQSVSSSYLA

SEQ ID NO: 10557 - protein, 12 aa, Artificial Sequence
  Description of Artificial Sequence: Synthetic peptide
RASQSVSSSYLA

SEQ ID NO: 10558 - protein, 12 aa, Artificial Sequence
  Description of Artificial Sequence: Synthetic peptide
RASQSVSSSYLA

SEQ ID NO: 10559 - protein, 12 aa, Artificial Sequence
  Description of Artificial Sequence: Synthetic peptide
RASQSVSSSYLA

SEQ ID NO: 10560 - protein, 12 aa, Artificial Sequence
  Description of Artificial Sequence: Synthetic peptide
RASQSVSSSYLA

SEQ ID NO: 10561 - protein, 12 aa, Artificial Sequence
  Description of Artificial Sequence: Synthetic peptide
RASQSVSSSYLA

SEQ ID NO: 10562 - protein, 16 aa, Artificial Sequence
  Description of Artificial Sequence: Synthetic peptide
RSSQSLLHSNGYNYLD

SEQ ID NO: 10563 - protein, 16 aa, Artificial Sequence
  Description of Artificial Sequence: Synthetic peptide
RSSQSLLYSNGYNYLD

SEQ ID NO: 10564 - protein, 16 aa, Artificial Sequence
  Description of Artificial Sequence: Synthetic peptide
RSSQSLLYSNGYHYLD

SEQ ID NO: 10565 - protein, 16 aa, Artificial Sequence
  Description of Artificial Sequence: Synthetic peptide
RSSQSLLYSNGYNYLD

SEQ ID NO: 10566 - protein, 16 aa, Artificial Sequence
  Description of Artificial Sequence: Synthetic peptide
RSSQSLLYSNGYNYLD

SEQ ID NO: 10567 - protein, 16 aa, Artificial Sequence
  Description of Artificial Sequence: Synthetic peptide
RSSQSLLHRNGYNYLD

SEQ ID NO: 10568 - protein, 16 aa, Artificial Sequence
  Description of Artificial Sequence: Synthetic peptide
RSSQSLLHSNGYNYLD

SEQ ID NO: 10569 - protein, 16 aa, Artificial Sequence
  Description of Artificial Sequence: Synthetic peptide
RSSQSLLHRNGYNYLD

SEQ ID NO: 10570 - protein, 16 aa, Artificial Sequence
  Description of Artificial Sequence: Synthetic peptide
RSSQSLLHRNGYHYLD

SEQ ID NO: 10571 - protein, 16 aa, Artificial Sequence
  Description of Artificial Sequence: Synthetic peptide
RSSQSLLHRNGYHYLD

SEQ ID NO: 10572 - protein, 16 aa, Artificial Sequence
  Description of Artificial Sequence: Synthetic peptide
RSSQSLLHRNGYNYLD

SEQ ID NO: 10573 - protein, 16 aa, Artificial Sequence
  Description of Artificial Sequence: Synthetic peptide
RSSQSLLHRNGYNYLD

SEQ ID NO: 10574 - protein, 11 aa, Artificial Sequence
  Description of Artificial Sequence: Synthetic peptide
RASQGISSWLA

SEQ ID NO: 10575 - protein, 11 aa, Artificial Sequence
  Description of Artificial Sequence: Synthetic peptide
RASQGISSWLA

SEQ ID NO: 10576 - protein, 11 aa, Artificial Sequence
  Description of Artificial Sequence: Synthetic peptide
RASQSISSYLN

SEQ ID NO: 10577 - protein, 16 aa, Artificial Sequence
  Description of Artificial Sequence: Synthetic peptide
RSSQSLLHSNGYNYLD

SEQ ID NO: 10578 - protein, 16 aa, Artificial Sequence
  Description of Artificial Sequence: Synthetic peptide
RSSQSLLYSNGYNYLD

SEQ ID NO: 10579 - protein, 16 aa, Artificial Sequence
  Description of Artificial Sequence: Synthetic peptide
RSSQSLLYSNGYNYVD

SEQ ID NO: 10580 - protein, 16 aa, Artificial Sequence
  Description of Artificial Sequence: Synthetic peptide
RSSQSLLYSNGYNYLD

SEQ ID NO: 10581 - protein, 16 aa, Artificial Sequence
  Description of Artificial Sequence: Synthetic peptide
RSSRSLLHSNGYNYLD

SEQ ID NO: 10582 - protein, 16 aa, Artificial Sequence
  Description of Artificial Sequence: Synthetic peptide
RSSQSLLHSNGYNYVD

SEQ ID NO: 10583 - protein, 17 aa, Artificial Sequence
  Description of Artificial Sequence: Synthetic peptide
RSSQSLLDSDDGNTYLD

SEQ ID NO: 10584 - protein, 16 aa, Artificial Sequence
  Description of Artificial Sequence: Synthetic peptide
RSSQSLLYSNGYNYVD

SEQ ID NO: 10585 - protein, 16 aa, Artificial Sequence
  Description of Artificial Sequence: Synthetic peptide
RSSQSLLHRNGYNYLD

SEQ ID NO: 10586 - protein, 11 aa, Artificial Sequence
  Description of Artificial Sequence: Synthetic peptide
RASQSISSYLN

SEQ ID NO: 10587 - protein, 11 aa, Artificial Sequence
  Description of Artificial Sequence: Synthetic peptide
RASQSISSYLN

SEQ ID NO: 10588 - protein, 11 aa, Artificial Sequence
  Description of Artificial Sequence: Synthetic peptide
RASQSISSYLN

SEQ ID NO: 10589 - protein, 11 aa, Artificial Sequence
  Description of Artificial Sequence: Synthetic peptide
QASQDISNYLN

SEQ ID NO: 10590 - protein, 11 aa, Artificial Sequence
  Description of Artificial Sequence: Synthetic peptide
RASQSISSYLN

SEQ ID NO: 10591 - protein, 11 aa, Artificial Sequence
  Description of Artificial Sequence: Synthetic peptide
QASQDISNYLN

SEQ ID NO: 10592 - protein, 11 aa, Artificial Sequence
  Description of Artificial Sequence: Synthetic peptide
QASQDISNYLN

SEQ ID NO: 10593 - protein, 11 aa, Artificial Sequence
  Description of Artificial Sequence: Synthetic peptide
QASQDISNYLN

SEQ ID NO: 10594 - protein, 17 aa, Artificial Sequence
  Description of Artificial Sequence: Synthetic peptide
RSSQSLLDSDDGNTYLD

SEQ ID NO: 10595 - protein, 16 aa, Artificial Sequence
  Description of Artificial Sequence: Synthetic peptide
RSSQSLLYSNGYNYLD

SEQ ID NO: 10596 - protein, 16 aa, Artificial Sequence
  Description of Artificial Sequence: Synthetic peptide
RSSQSLLHSNGYNYLD

SEQ ID NO: 10597 - protein, 16 aa, Artificial Sequence
  Description of Artificial Sequence: Synthetic peptide
RSSQSLLHSNGYNYLD

SEQ ID NO: 10598 - protein, 16 aa, Artificial Sequence
  Description of Artificial Sequence: Synthetic peptide
RSSQSLLYSNGYNYLD

SEQ ID NO: 10599 - protein, 16 aa, Artificial Sequence
  Description of Artificial Sequence: Synthetic peptide
RSSQSLLYSNGYNYVD

SEQ ID NO: 10600 - protein, 16 aa, Artificial Sequence
  Description of Artificial Sequence: Synthetic peptide
RSSQSLLFSNGYYYLD

SEQ ID NO: 10601 - protein, 16 aa, Artificial Sequence
  Description of Artificial Sequence: Synthetic peptide
RSSQSLLHSNGYNYLD

SEQ ID NO: 10602 - protein, 16 aa, Artificial Sequence
  Description of Artificial Sequence: Synthetic peptide
RSSQSLLHSNGYNYLD

SEQ ID NO: 10603 - protein, 16 aa, Artificial Sequence
  Description of Artificial Sequence: Synthetic peptide
RSSQSLLHRNGYNYLD

SEQ ID NO: 10604 - protein, 16 aa, Artificial Sequence
  Description of Artificial Sequence: Synthetic peptide
RSSQSLLHSNGYNYLD

SEQ ID NO: 10605 - protein, 16 aa, Artificial Sequence
  Description of Artificial Sequence: Synthetic peptide
RSSQSLLHSTGYNYVD

SEQ ID NO: 10606 - protein, 16 aa, Artificial Sequence
  Description of Artificial Sequence: Synthetic peptide
RSSQSLLHSSGYNYLD

SEQ ID NO: 10607 - protein, 17 aa, Artificial Sequence
  Description of Artificial Sequence: Synthetic peptide
RSSQSLLDSDDGNTYLD

SEQ ID NO: 10608 - protein, 16 aa, Artificial Sequence
  Description of Artificial Sequence: Synthetic peptide
RSSQSLLFSNGYNYLD

SEQ ID NO: 10609 - protein, 16 aa, Artificial Sequence
  Description of Artificial Sequence: Synthetic peptide
RSSQSLLYSNGYNYLD

SEQ ID NO: 10610 - protein, 16 aa, Artificial Sequence
  Description of Artificial Sequence: Synthetic peptide
RSSQSLLYSNGYNYLD

SEQ ID NO: 10611 - protein, 11 aa, Artificial Sequence
  Description of Artificial Sequence: Synthetic peptide
RASQGISNYLA

SEQ ID NO: 10612 - protein, 11 aa, Artificial Sequence
  Description of Artificial Sequence: Synthetic peptide
RASQGISNYLA

SEQ ID NO: 10613 - protein, 11 aa, Artificial Sequence
  Description of Artificial Sequence: Synthetic peptide
RASQGISNYLA

SEQ ID NO: 10614 - protein, 11 aa, Artificial Sequence
  Description of Artificial Sequence: Synthetic peptide
RASQGISNYLA

SEQ ID NO: 10615 - protein, 11 aa, Artificial Sequence
  Description of Artificial Sequence: Synthetic peptide
RASQGISNYLA

SEQ ID NO: 10616 - protein, 11 aa, Artificial Sequence
  Description of Artificial Sequence: Synthetic peptide
RASQGISNYLA

SEQ ID NO: 10617 - protein, 11 aa, Artificial Sequence
  Description of Artificial Sequence: Synthetic peptide
RASQGISNYLA

SEQ ID NO: 10618 - protein, 17 aa, Artificial Sequence
  Description of Artificial Sequence: Synthetic peptide
RSSQSLLDSDDGNTYLD

SEQ ID NO: 10619 - protein, 16 aa, Artificial Sequence
  Description of Artificial Sequence: Synthetic peptide
RSSQSLLYSNGYNYLD

SEQ ID NO: 10620 - protein, 11 aa, Artificial Sequence
  Description of Artificial Sequence: Synthetic peptide
RASQGISNYLA

SEQ ID NO: 10621 - protein, 11 aa, Artificial Sequence
  Description of Artificial Sequence: Synthetic peptide
RASQGISNYLA

SEQ ID NO: 10622 - protein, 16 aa, Artificial Sequence
  Description of Artificial Sequence: Synthetic peptide
KSSQSLLHSDGKTYLY

SEQ ID NO: 10623 - protein, 16 aa, Artificial Sequence
  Description of Artificial Sequence: Synthetic peptide
KSSQSLLYSNGYNYLD

SEQ ID NO: 10624 - protein, 17 aa, Artificial Sequence
  Description of Artificial Sequence: Synthetic peptide
KSSQSVLYSSNNKNYLA

SEQ ID NO: 10625 - protein, 17 aa, Artificial Sequence
  Description of Artificial Sequence: Synthetic peptide
KSSQSVLYSSNNKNYLA

SEQ ID NO: 10626 - protein, 17 aa, Artificial Sequence
  Description of Artificial Sequence: Synthetic peptide
KSSQSVLYSSNNKNYLA

SEQ ID NO: 10627 - protein, 17 aa, Artificial Sequence
  Description of Artificial Sequence: Synthetic peptide
KSSQSVLYSSNNKNYLA

SEQ ID NO: 10628 - protein, 11 aa, Artificial Sequence
  Description of Artificial Sequence: Synthetic peptide
QASQDISNYLN

SEQ ID NO: 10629 - protein, 11 aa, Artificial Sequence
  Description of Artificial Sequence: Synthetic peptide
QASQDISNYLN

SEQ ID NO: 10630 - protein, 17 aa, Artificial Sequence
  Description of Artificial Sequence: Synthetic peptide
KSSQSVLYSSNNKNYLA

SEQ ID NO: 10631 - protein, 17 aa, Artificial Sequence
  Description of Artificial Sequence: Synthetic peptide
KSSQSVLYSSNNKNYLA

SEQ ID NO: 10632 - protein, 17 aa, Artificial Sequence
  Description of Artificial Sequence: Synthetic peptide
KSSQSVLYSSNNKNYLA

SEQ ID NO: 10633 - protein, 17 aa, Artificial Sequence
  Description of Artificial Sequence: Synthetic peptide
KSSQSVLYSSNNKNYLA

SEQ ID NO: 10634 - protein, 17 aa, Artificial Sequence
  Description of Artificial Sequence: Synthetic peptide
KSSQSVLYSSNNKNYLA

SEQ ID NO: 10635 - protein, 11 aa, Artificial Sequence
  Description of Artificial Sequence: Synthetic peptide
RASQSISSYLN

SEQ ID NO: 10636 - protein, 11 aa, Artificial Sequence
  Description of Artificial Sequence: Synthetic peptide
RASQSISSYLN

SEQ ID NO: 10637 - protein, 11 aa, Artificial Sequence
  Description of Artificial Sequence: Synthetic peptide
RASQSISSYLN

SEQ ID NO: 10638 - protein, 11 aa, Artificial Sequence
  Description of Artificial Sequence: Synthetic peptide
RTSQSISSYLN

SEQ ID NO: 10639 - protein, 11 aa, Artificial Sequence
  Description of Artificial Sequence: Synthetic peptide
RASQSISNYFN

SEQ ID NO: 10640 - protein, 11 aa, Artificial Sequence
  Description of Artificial Sequence: Synthetic peptide
RASQSISSYLN

SEQ ID NO: 10641 - protein, 11 aa, Artificial Sequence
  Description of Artificial Sequence: Synthetic peptide
RTSQSISSYLN

SEQ ID NO: 10642 - protein, 11 aa, Artificial Sequence
  Description of Artificial Sequence: Synthetic peptide
RASQSISSYLN

SEQ ID NO: 10643 - protein, 11 aa, Artificial Sequence
  Description of Artificial Sequence: Synthetic peptide
RTSQSISSYLN

SEQ ID NO: 10644 - protein, 11 aa, Artificial Sequence
  Description of Artificial Sequence: Synthetic peptide
RTSQSISSYLN

SEQ ID NO: 10645 - protein, 11 aa, Artificial Sequence
  Description of Artificial Sequence: Synthetic peptide
RASQSISSYLN

SEQ ID NO: 10646 - protein, 11 aa, Artificial Sequence
  Description of Artificial Sequence: Synthetic peptide
RASQSISSYLN

SEQ ID NO: 10647 - protein, 11 aa, Artificial Sequence
  Description of Artificial Sequence: Synthetic peptide
QASQDISNYLN

SEQ ID NO: 10648 - protein, 11 aa, Artificial Sequence
  Description of Artificial Sequence: Synthetic peptide
RTSQSISSYLN

SEQ ID NO: 10649 - protein, 11 aa, Artificial Sequence
  Description of Artificial Sequence: Synthetic peptide
RTSQSISSYLN

SEQ ID NO: 10650 - protein, 11 aa, Artificial Sequence
  Description of Artificial Sequence: Synthetic peptide
RASQSISSYLN

SEQ ID NO: 10651 - protein, 11 aa, Artificial Sequence
  Description of Artificial Sequence: Synthetic peptide
RASQSISSYLN

SEQ ID NO: 10652 - protein, 11 aa, Artificial Sequence
  Description of Artificial Sequence: Synthetic peptide
QARQDISDYLN

SEQ ID NO: 10653 - protein, 11 aa, Artificial Sequence
  Description of Artificial Sequence: Synthetic peptide
RTSQSINSYLN

SEQ ID NO: 10654 - protein, 11 aa, Artificial Sequence
  Description of Artificial Sequence: Synthetic peptide
RTSQSISSYLN

SEQ ID NO: 10655 - protein, 11 aa, Artificial Sequence
  Description of Artificial Sequence: Synthetic peptide
RTSQSINSYLN

SEQ ID NO: 10656 - protein, 11 aa, Artificial Sequence
  Description of Artificial Sequence: Synthetic peptide
RTSQSISSYLN

SEQ ID NO: 10657 - protein, 11 aa, Artificial Sequence
  Description of Artificial Sequence: Synthetic peptide
RASQFISSYLN

SEQ ID NO: 10658 - protein, 11 aa, Artificial Sequence
  Description of Artificial Sequence: Synthetic peptide
RASQSISSYLN

SEQ ID NO: 10659 - protein, 11 aa, Artificial Sequence
  Description of Artificial Sequence: Synthetic peptide
QASQDISNYLN

SEQ ID NO: 10660 - protein, 11 aa, Artificial Sequence
  Description of Artificial Sequence: Synthetic peptide
RTSQSISSYLN

SEQ ID NO: 10661 - protein, 11 aa, Artificial Sequence
  Description of Artificial Sequence: Synthetic peptide
RTSQSISSYLN

SEQ ID NO: 10662 - protein, 11 aa, Artificial Sequence
  Description of Artificial Sequence: Synthetic peptide
RTSQSISSYLN

SEQ ID NO: 10663 - protein, 11 aa, Artificial Sequence
  Description of Artificial Sequence: Synthetic peptide
RTSQSISSYLN

SEQ ID NO: 10664 - protein, 11 aa, Artificial Sequence
  Description of Artificial Sequence: Synthetic peptide
RTSQSISSYLN

SEQ ID NO: 10665 - protein, 11 aa, Artificial Sequence
  Description of Artificial Sequence: Synthetic peptide
RTSQSISSYLN

SEQ ID NO: 10666 - protein, 11 aa, Artificial Sequence
  Description of Artificial Sequence: Synthetic peptide
RTSQSISSYLN

SEQ ID NO: 10667 - protein, 11 aa, Artificial Sequence
  Description of Artificial Sequence: Synthetic peptide
RTSQSISSYLN

SEQ ID NO: 10668 - protein, 11 aa, Artificial Sequence
  Description of Artificial Sequence: Synthetic peptide
QASQDISNYFN

SEQ ID NO: 10669 - protein, 11 aa, Artificial Sequence
  Description of Artificial Sequence: Synthetic peptide
RTSQSISSYLN

SEQ ID NO: 10670 - protein, 11 aa, Artificial Sequence
  Description of Artificial Sequence: Synthetic peptide
RTSQSISSYLN

SEQ ID NO: 10671 - protein, 11 aa, Artificial Sequence
  Description of Artificial Sequence: Synthetic peptide
RTSQSISSYLN

SEQ ID NO: 10672 - protein, 11 aa, Artificial Sequence
  Description of Artificial Sequence: Synthetic peptide
RASQGISSWLA

SEQ ID NO: 10673 - protein, 11 aa, Artificial Sequence
  Description of Artificial Sequence: Synthetic peptide
QASQDISNYLN

SEQ ID NO: 10674 - protein, 12 aa, Artificial Sequence
  Description of Artificial Sequence: Synthetic peptide
RASQSVSSSYLA

SEQ ID NO: 10675 - protein, 16 aa, Artificial Sequence
  Description of Artificial Sequence: Synthetic peptide
RSSQSLLHRNGYNYLD

SEQ ID NO: 10676 - protein, 11 aa, Artificial Sequence
  Description of Artificial Sequence: Synthetic peptide
RASQGISNYLA

SEQ ID NO: 10677 - protein, 11 aa, Artificial Sequence
  Description of Artificial Sequence: Synthetic peptide
RASQGISNYLA

SEQ ID NO: 10678 - protein, 17 aa, Artificial Sequence
  Description of Artificial Sequence: Synthetic peptide
KSSQSVLYSSNNKNYLA

SEQ ID NO: 10679 - protein, 17 aa, Artificial Sequence
  Description of Artificial Sequence: Synthetic peptide
KSSQSVLYSSNNKNYLA

SEQ ID NO: 10680 - protein, 17 aa, Artificial Sequence
  Description of Artificial Sequence: Synthetic peptide
KSSQSVLYSSNNKNYLA

SEQ ID NO: 10681 - protein, 11 aa, Artificial Sequence
  Description of Artificial Sequence: Synthetic peptide
RASQSISSYLN

SEQ ID NO: 10682 - protein, 11 aa, Artificial Sequence
  Description of Artificial Sequence: Synthetic peptide
RASQSISSYLN

SEQ ID NO: 10683 - protein, 14 aa, Artificial Sequence
  Description of Artificial Sequence: Synthetic peptide
TGTSSDVGGYNYVS

SEQ ID NO: 10684 - protein, 14 aa, Artificial Sequence
  Description of Artificial Sequence: Synthetic peptide
TGTSSDVGGYNYVS

SEQ ID NO: 10685 - protein, 13 aa, Artificial Sequence
  Description of Artificial Sequence: Synthetic peptide
SGSSSNIGSNYVY

SEQ ID NO: 10686 - protein, 13 aa, Artificial Sequence
  Description of Artificial Sequence: Synthetic peptide
SGSSSNIGSNYVY

SEQ ID NO: 10687 - protein, 13 aa, Artificial Sequence
  Description of Artificial Sequence: Synthetic peptide
TGNSNNVGNQGAA

SEQ ID NO: 10688 - protein, 13 aa, Artificial Sequence
  Description of Artificial Sequence: Synthetic peptide
TGNSNNVGNQGAA

SEQ ID NO: 10689 - protein, 13 aa, Artificial Sequence
  Description of Artificial Sequence: Synthetic peptide
TGNSNNVGNQGAA

SEQ ID NO: 10690 - protein, 14 aa, Artificial Sequence
  Description of Artificial Sequence: Synthetic peptide
TGTSSDVGGYNYVS

SEQ ID NO: 10691 - protein, 14 aa, Artificial Sequence
  Description of Artificial Sequence: Synthetic peptide
TGTSSDVGGYNYVS

SEQ ID NO: 10692 - protein, 13 aa, Artificial Sequence
  Description of Artificial Sequence: Synthetic peptide
TGNSNNVGNQGAA

SEQ ID NO: 10693 - protein, 13 aa, Artificial Sequence
  Description of Artificial Sequence: Synthetic peptide
TGNSNNVGNQGAA

SEQ ID NO: 10694 - protein, 11 aa, Artificial Sequence
  Description of Artificial Sequence: Synthetic peptide
GGNNIGSKSVH

SEQ ID NO: 10695 - protein, 11 aa, Artificial Sequence
  Description of Artificial Sequence: Synthetic peptide
GGNNIGSKSVH

SEQ ID NO: 10696 - protein, 11 aa, Artificial Sequence
  Description of Artificial Sequence: Synthetic peptide
GGNNIGSKSVQ

SEQ ID NO: 10697 - protein, 11 aa, Artificial Sequence
  Description of Artificial Sequence: Synthetic peptide
GGNNIGSKSVH

SEQ ID NO: 10698 - protein, 11 aa, Artificial Sequence
  Description of Artificial Sequence: Synthetic peptide
GGNNIGSKSVH

SEQ ID NO: 10699 - protein, 11 aa, Artificial Sequence
  Description of Artificial Sequence: Synthetic peptide
GGNNIGSKSVH

SEQ ID NO: 10700 - protein, 11 aa, Artificial Sequence
  Description of Artificial Sequence: Synthetic peptide
GGNNIGSKSVH

SEQ ID NO: 10701 - protein, 11 aa, Artificial Sequence
  Description of Artificial Sequence: Synthetic peptide
GGNNIGSKSVH

SEQ ID NO: 10702 - protein, 11 aa, Artificial Sequence
  Description of Artificial Sequence: Synthetic peptide
GGNNIGSKSVH

SEQ ID NO: 10703 - protein, 11 aa, Artificial Sequence
  Description of Artificial Sequence: Synthetic peptide
GGNNIGSKSVH

SEQ ID NO: 10704 - protein, 11 aa, Artificial Sequence
  Description of Artificial Sequence: Synthetic peptide
GGNNIGSKSVQ

SEQ ID NO: 10705 - protein, 11 aa, Artificial Sequence
  Description of Artificial Sequence: Synthetic peptide
GGNNIGSKSVH

SEQ ID NO: 10706 - protein, 11 aa, Artificial Sequence
  Description of Artificial Sequence: Synthetic peptide
GGNNIGSKSVQ

SEQ ID NO: 10707 - protein, 11 aa, Artificial Sequence
  Description of Artificial Sequence: Synthetic peptide
GGNNIGSKSVH

SEQ ID NO: 10708 - protein, 11 aa, Artificial Sequence
  Description of Artificial Sequence: Synthetic peptide
GGNNIGSKSVH

SEQ ID NO: 10709 - protein, 11 aa, Artificial Sequence
  Description of Artificial Sequence: Synthetic peptide
GGNNIGIKSVH

SEQ ID NO: 10710 - protein, 11 aa, Artificial Sequence
  Description of Artificial Sequence: Synthetic peptide
GGNNIGSKSVH

SEQ ID NO: 10711 - protein, 11 aa, Artificial Sequence
  Description of Artificial Sequence: Synthetic peptide
GGNNIGSKSVH

SEQ ID NO: 10712 - protein, 11 aa, Artificial Sequence
  Description of Artificial Sequence: Synthetic peptide
GGNNIGSKSVH

SEQ ID NO: 10713 - protein, 11 aa, Artificial Sequence
  Description of Artificial Sequence: Synthetic peptide
GGNNIGSKSVQ

SEQ ID NO: 10714 - protein, 11 aa, Artificial Sequence
  Description of Artificial Sequence: Synthetic peptide
GGNNIGSKSVH

SEQ ID NO: 10715 - protein, 11 aa, Artificial Sequence
  Description of Artificial Sequence: Synthetic peptide
GGNNIGSKSVH

SEQ ID NO: 10716 - protein, 11 aa, Artificial Sequence
  Description of Artificial Sequence: Synthetic peptide
GGNNIGSKSVH

SEQ ID NO: 10717 - protein, 11 aa, Artificial Sequence
  Description of Artificial Sequence: Synthetic peptide
GGNNIGSKSVQ

SEQ ID NO: 10718 - protein, 11 aa, Artificial Sequence
  Description of Artificial Sequence: Synthetic peptide
GGNNIGSKSVH

SEQ ID NO: 10719 - protein, 11 aa, Artificial Sequence
  Description of Artificial Sequence: Synthetic peptide
GGNNIGSKSVH

SEQ ID NO: 10720 - protein, 11 aa, Artificial Sequence
  Description of Artificial Sequence: Synthetic peptide
GGNNIGSKSVH

SEQ ID NO: 10721 - protein, 11 aa, Artificial Sequence
  Description of Artificial Sequence: Synthetic peptide
GGNNIGSKSVH

SEQ ID NO: 10722 - protein, 11 aa, Artificial Sequence
  Description of Artificial Sequence: Synthetic peptide
GGNNIGSKSVH

SEQ ID NO: 10723 - protein, 11 aa, Artificial Sequence
  Description of Artificial Sequence: Synthetic peptide
GGNNIGSKSVH

SEQ ID NO: 10724 - protein, 11 aa, Artificial Sequence
  Description of Artificial Sequence: Synthetic peptide
GGNNIGSKSVH

SEQ ID NO: 10725 - protein, 11 aa, Artificial Sequence
  Description of Artificial Sequence: Synthetic peptide
GGNNIGSKSVH

SEQ ID NO: 10726 - protein, 11 aa, Artificial Sequence
  Description of Artificial Sequence: Synthetic peptide
GGNNIGSKGVQ

SEQ ID NO: 10727 - protein, 11 aa, Artificial Sequence
  Description of Artificial Sequence: Synthetic peptide
GGNNIGSKSVQ

SEQ ID NO: 10728 - protein, 11 aa, Artificial Sequence
  Description of Artificial Sequence: Synthetic peptide
GGNNIGSKSVH

SEQ ID NO: 10729 - protein, 11 aa, Artificial Sequence
  Description of Artificial Sequence: Synthetic peptide
GGNNIGSKSVH

SEQ ID NO: 10730 - protein, 11 aa, Artificial Sequence
  Description of Artificial Sequence: Synthetic peptide
GGNNIGSKSVH

SEQ ID NO: 10731 - protein, 11 aa, Artificial Sequence
  Description of Artificial Sequence: Synthetic peptide
GGNNIGSKSVH

SEQ ID NO: 10732 - protein, 11 aa, Artificial Sequence
  Description of Artificial Sequence: Synthetic peptide
GGNNIGSKSVH

SEQ ID NO: 10733 - protein, 11 aa, Artificial Sequence
  Description of Artificial Sequence: Synthetic peptide
GGNNIGSKSVH

SEQ ID NO: 10734 - protein, 11 aa, Artificial Sequence
  Description of Artificial Sequence: Synthetic peptide
GGNNIGSKSVH

SEQ ID NO: 10735 - protein, 11 aa, Artificial Sequence
  Description of Artificial Sequence: Synthetic peptide
GGNNIGSKSVH

SEQ ID NO: 10736 - protein, 11 aa, Artificial Sequence
  Description of Artificial Sequence: Synthetic peptide
GGNNIGSKSVH

SEQ ID NO: 10737 - protein, 11 aa, Artificial Sequence
  Description of Artificial Sequence: Synthetic peptide
GGNNIGSKSVH

SEQ ID NO: 10738 - protein, 11 aa, Artificial Sequence
  Description of Artificial Sequence: Synthetic peptide
GGNNIGSKSVH

SEQ ID NO: 10739 - protein, 11 aa, Artificial Sequence
  Description of Artificial Sequence: Synthetic peptide
GGNNIGSKSVH

SEQ ID NO: 10740 - protein, 11 aa, Artificial Sequence
  Description of Artificial Sequence: Synthetic peptide
GGNNIGSKSVH

SEQ ID NO: 10741 - protein, 11 aa, Artificial Sequence
  Description of Artificial Sequence: Synthetic peptide
GGNNIGSKSVH

SEQ ID NO: 10742 - protein, 11 aa, Artificial Sequence
  Description of Artificial Sequence: Synthetic peptide
GGNNIGSKSVH

SEQ ID NO: 10743 - protein, 11 aa, Artificial Sequence
  Description of Artificial Sequence: Synthetic peptide
GGNNIGSKSVH

SEQ ID NO: 10744 - protein, 11 aa, Artificial Sequence
  Description of Artificial Sequence: Synthetic peptide
GGNNIGSKSVH

SEQ ID NO: 10745 - protein, 11 aa, Artificial Sequence
  Description of Artificial Sequence: Synthetic peptide
GGNNIGSKSVH

SEQ ID NO: 10746 - protein, 11 aa, Artificial Sequence
  Description of Artificial Sequence: Synthetic peptide
GGNNIGSKSVH

SEQ ID NO: 10747 - protein, 11 aa, Artificial Sequence
  Description of Artificial Sequence: Synthetic peptide
GGNNIGSKSVH

SEQ ID NO: 10748 - protein, 11 aa, Artificial Sequence
  Description of Artificial Sequence: Synthetic peptide
GGNNIGSKSVH

SEQ ID NO: 10749 - protein, 11 aa, Artificial Sequence
  Description of Artificial Sequence: Synthetic peptide
GGNNIGSKSVH

SEQ ID NO: 10750 - protein, 11 aa, Artificial Sequence
  Description of Artificial Sequence: Synthetic peptide
GGNNIGSKSVH

SEQ ID NO: 10751 - protein, 11 aa, Artificial Sequence
  Description of Artificial Sequence: Synthetic peptide
GGNNIGSKSVH

SEQ ID NO: 10752 - protein, 11 aa, Artificial Sequence
  Description of Artificial Sequence: Synthetic peptide
GGNNIGSKSVH

SEQ ID NO: 10753 - protein, 11 aa, Artificial Sequence
  Description of Artificial Sequence: Synthetic peptide
GGNNIGSKSVH

SEQ ID NO: 10754 - protein, 11 aa, Artificial Sequence
  Description of Artificial Sequence: Synthetic peptide
GGNNIGSKSVH

SEQ ID NO: 10755 - protein, 11 aa, Artificial Sequence
  Description of Artificial Sequence: Synthetic peptide
GGNNIGSKSVH

SEQ ID NO: 10756 - protein, 5 aa, Artificial Sequence
  Description of Artificial Sequence: Synthetic peptide
DYYMH

SEQ ID NO: 10757 - protein, 5 aa, Artificial Sequence
  Description of Artificial Sequence: Synthetic peptide
KSWMN

SEQ ID NO: 10758 - protein, 5 aa, Artificial Sequence
  Description of Artificial Sequence: Synthetic peptide
SYAIS

SEQ ID NO: 10759 - protein, 5 aa, Artificial Sequence
  Description of Artificial Sequence: Synthetic peptide
KSWMN

SEQ ID NO: 10760 - protein, 5 aa, Artificial Sequence
  Description of Artificial Sequence: Synthetic peptide
SYAIS

SEQ ID NO: 10761 - protein, 5 aa, Artificial Sequence
  Description of Artificial Sequence: Synthetic peptide
SSWMN

SEQ ID NO: 10762 - protein, 5 aa, Artificial Sequence
  Description of Artificial Sequence: Synthetic peptide
SYDIN

SEQ ID NO: 10763 - protein, 5 aa, Artificial Sequence
  Description of Artificial Sequence: Synthetic peptide
SYDIN

SEQ ID NO: 10764 - protein, 5 aa, Artificial Sequence
  Description of Artificial Sequence: Synthetic peptide
SYDIN

SEQ ID NO: 10765 - protein, 5 aa, Artificial Sequence
  Description of Artificial Sequence: Synthetic peptide
SYDIN

SEQ ID NO: 10766 - protein, 5 aa, Artificial Sequence
  Description of Artificial Sequence: Synthetic peptide
SYDIN

SEQ ID NO: 10767 - protein, 5 aa, Artificial Sequence
  Description of Artificial Sequence: Synthetic peptide
GYDIN

SEQ ID NO: 10768 - protein, 5 aa, Artificial Sequence
  Description of Artificial Sequence: Synthetic peptide
SYDIN

SEQ ID NO: 10769 - protein, 5 aa, Artificial Sequence
  Description of Artificial Sequence: Synthetic peptide
GYYWS

SEQ ID NO: 10770 - protein, 5 aa, Artificial Sequence
  Description of Artificial Sequence: Synthetic peptide
GYYWN

SEQ ID NO: 10771 - protein, 5 aa, Artificial Sequence
  Description of Artificial Sequence: Synthetic peptide
GYYWT

SEQ ID NO: 10772 - protein, 5 aa, Artificial Sequence
  Description of Artificial Sequence: Synthetic peptide
GYYWN

SEQ ID NO: 10773 - protein, 5 aa, Artificial Sequence
  Description of Artificial Sequence: Synthetic peptide
GYYWN

SEQ ID NO: 10774 - protein, 5 aa, Artificial Sequence
  Description of Artificial Sequence: Synthetic peptide
GFYWN

SEQ ID NO: 10775 - protein, 5 aa, Artificial Sequence
  Description of Artificial Sequence: Synthetic peptide
GYYWN

SEQ ID NO: 10776 - protein, 5 aa, Artificial Sequence
  Description of Artificial Sequence: Synthetic peptide
GYYWS

SEQ ID NO: 10777 - protein, 5 aa, Artificial Sequence
  Description of Artificial Sequence: Synthetic peptide
GYYWS

SEQ ID NO: 10778 - protein, 5 aa, Artificial Sequence
  Description of Artificial Sequence: Synthetic peptide
GYYWS

SEQ ID NO: 10779 - protein, 5 aa, Artificial Sequence
  Description of Artificial Sequence: Synthetic peptide
GYYWN

SEQ ID NO: 10780 - protein, 5 aa, Artificial Sequence
  Description of Artificial Sequence: Synthetic peptide
SYAMS

SEQ ID NO: 10781 - protein, 5 aa, Artificial Sequence
  Description of Artificial Sequence: Synthetic peptide
SYAMS

SEQ ID NO: 10782 - protein, 5 aa, Artificial Sequence
  Description of Artificial Sequence: Synthetic peptide
SYAMS

SEQ ID NO: 10783 - protein, 5 aa, Artificial Sequence
  Description of Artificial Sequence: Synthetic peptide
SYAMS

SEQ ID NO: 10784 - protein, 5 aa, Artificial Sequence
  Description of Artificial Sequence: Synthetic peptide
SYAMS

SEQ ID NO: 10785 - protein, 5 aa, Artificial Sequence
  Description of Artificial Sequence: Synthetic peptide
SYAMS

SEQ ID NO: 10786 - protein, 5 aa, Artificial Sequence
  Description of Artificial Sequence: Synthetic peptide
SYAMH

SEQ ID NO: 10787 - protein, 5 aa, Artificial Sequence
  Description of Artificial Sequence: Synthetic peptide
SYRMH

SEQ ID NO: 10788 - protein, 5 aa, Artificial Sequence
  Description of Artificial Sequence: Synthetic peptide
SYGMH

SEQ ID NO: 10789 - protein, 5 aa, Artificial Sequence
  Description of Artificial Sequence: Synthetic peptide
GYYWS

SEQ ID NO: 10790 - protein, 5 aa, Artificial Sequence
  Description of Artificial Sequence: Synthetic peptide
GYYWN

SEQ ID NO: 10791 - protein, 5 aa, Artificial Sequence
  Description of Artificial Sequence: Synthetic peptide
GYYWN

SEQ ID NO: 10792 - protein, 5 aa, Artificial Sequence
  Description of Artificial Sequence: Synthetic peptide
GYYWS

SEQ ID NO: 10793 - protein, 5 aa, Artificial Sequence
  Description of Artificial Sequence: Synthetic peptide
GYYWS

SEQ ID NO: 10794 - protein, 5 aa, Artificial Sequence
  Description of Artificial Sequence: Synthetic peptide
GYYWS

SEQ ID NO: 10795 - protein, 5 aa, Artificial Sequence
  Description of Artificial Sequence: Synthetic peptide
GYYWS

SEQ ID NO: 10796 - protein, 5 aa, Artificial Sequence
  Description of Artificial Sequence: Synthetic peptide
GYYWN

SEQ ID NO: 10797 - protein, 5 aa, Artificial Sequence
  Description of Artificial Sequence: Synthetic peptide
GYYWS

SEQ ID NO: 10798 - protein, 5 aa, Artificial Sequence
  Description of Artificial Sequence: Synthetic peptide
GYYWS

SEQ ID NO: 10799 - protein, 5 aa, Artificial Sequence
  Description of Artificial Sequence: Synthetic peptide
SYAMS

SEQ ID NO: 10800 - protein, 5 aa, Artificial Sequence
  Description of Artificial Sequence: Synthetic peptide
SYAMS

SEQ ID NO: 10801 - protein, 5 aa, Artificial Sequence
  Description of Artificial Sequence: Synthetic peptide
SYAMS

SEQ ID NO: 10802 - protein, 5 aa, Artificial Sequence
  Description of Artificial Sequence: Synthetic peptide
SYAMS

SEQ ID NO: 10803 - protein, 5 aa, Artificial Sequence
  Description of Artificial Sequence: Synthetic peptide
SYAMS

SEQ ID NO: 10804 - protein, 5 aa, Artificial Sequence
  Description of Artificial Sequence: Synthetic peptide
SYAMS

SEQ ID NO: 10805 - protein, 5 aa, Artificial Sequence
  Description of Artificial Sequence: Synthetic peptide
SYGMS

SEQ ID NO: 10806 - protein, 5 aa, Artificial Sequence
  Description of Artificial Sequence: Synthetic peptide
NYAMS

SEQ ID NO: 10807 - protein, 5 aa, Artificial Sequence
  Description of Artificial Sequence: Synthetic peptide
IYGMS

SEQ ID NO: 10808 - protein, 5 aa, Artificial Sequence
  Description of Artificial Sequence: Synthetic peptide
SYAMS

SEQ ID NO: 10809 - protein, 5 aa, Artificial Sequence
  Description of Artificial Sequence: Synthetic peptide
SYAMS

SEQ ID NO: 10810 - protein, 5 aa, Artificial Sequence
  Description of Artificial Sequence: Synthetic peptide
SYGMS

SEQ ID NO: 10811 - protein, 5 aa, Artificial Sequence
  Description of Artificial Sequence: Synthetic peptide
SYAMS

SEQ ID NO: 10812 - protein, 7 aa, Artificial Sequence
  Description of Artificial Sequence: Synthetic peptide
SGGYYWS

SEQ ID NO: 10813 - protein, 7 aa, Artificial Sequence
  Description of Artificial Sequence: Synthetic peptide
RDPYYWS

SEQ ID NO: 10814 - protein, 7 aa, Artificial Sequence
  Description of Artificial Sequence: Synthetic peptide
SGDYYWS

SEQ ID NO: 10815 - protein, 7 aa, Artificial Sequence
  Description of Artificial Sequence: Synthetic peptide
SNPYYWS

SEQ ID NO: 10816 - protein, 7 aa, Artificial Sequence
  Description of Artificial Sequence: Synthetic peptide
SGDYYWS

SEQ ID NO: 10817 - protein, 7 aa, Artificial Sequence
  Description of Artificial Sequence: Synthetic peptide
SGDYYWS

SEQ ID NO: 10818 - protein, 7 aa, Artificial Sequence
  Description of Artificial Sequence: Synthetic peptide
SGDYYWS

SEQ ID NO: 10819 - protein, 7 aa, Artificial Sequence
  Description of Artificial Sequence: Synthetic peptide
SGDYYWS

SEQ ID NO: 10820 - protein, 7 aa, Artificial Sequence
  Description of Artificial Sequence: Synthetic peptide
SNPYYWS

SEQ ID NO: 10821 - protein, 7 aa, Artificial Sequence
  Description of Artificial Sequence: Synthetic peptide
SNPYYWS

SEQ ID NO: 10822 - protein, 7 aa, Artificial Sequence
  Description of Artificial Sequence: Synthetic peptide
SGDYYWS

SEQ ID NO: 10823 - protein, 7 aa, Artificial Sequence
  Description of Artificial Sequence: Synthetic peptide
SGDYYWS

SEQ ID NO: 10824 - protein, 7 aa, Artificial Sequence
  Description of Artificial Sequence: Synthetic peptide
SNPYYWS

SEQ ID NO: 10825 - protein, 7 aa, Artificial Sequence
  Description of Artificial Sequence: Synthetic peptide
SGDYYWS

SEQ ID NO: 10826 - protein, 7 aa, Artificial Sequence
  Description of Artificial Sequence: Synthetic peptide
SNPYYWS

SEQ ID NO: 10827 - protein, 7 aa, Artificial Sequence
  Description of Artificial Sequence: Synthetic peptide
SNPYYWS

SEQ ID NO: 10828 - protein, 7 aa, Artificial Sequence
  Description of Artificial Sequence: Synthetic peptide
SNPYYWS

SEQ ID NO: 10829 - protein, 7 aa, Artificial Sequence
  Description of Artificial Sequence: Synthetic peptide
SNPYYWS

SEQ ID NO: 10830 - protein, 7 aa, Artificial Sequence
  Description of Artificial Sequence: Synthetic peptide
SNPYYWS

SEQ ID NO: 10831 - protein, 5 aa, Artificial Sequence
  Description of Artificial Sequence: Synthetic peptide
SYAMS

SEQ ID NO: 10832 - protein, 5 aa, Artificial Sequence
  Description of Artificial Sequence: Synthetic peptide
SFAMS

SEQ ID NO: 10833 - protein, 5 aa, Artificial Sequence
  Description of Artificial Sequence: Synthetic peptide
SYGMH

SEQ ID NO: 10834 - protein, 5 aa, Artificial Sequence
  Description of Artificial Sequence: Synthetic peptide
RYGMD

SEQ ID NO: 10835 - protein, 5 aa, Artificial Sequence
  Description of Artificial Sequence: Synthetic peptide
RYGMD

SEQ ID NO: 10836 - protein, 5 aa, Artificial Sequence
  Description of Artificial Sequence: Synthetic peptide
SYDIN

SEQ ID NO: 10837 - protein, 5 aa, Artificial Sequence
  Description of Artificial Sequence: Synthetic peptide
SYDIN

SEQ ID NO: 10838 - protein, 5 aa, Artificial Sequence
  Description of Artificial Sequence: Synthetic peptide
SYDIN

SEQ ID NO: 10839 - protein, 5 aa, Artificial Sequence
  Description of Artificial Sequence: Synthetic peptide
SYDIN

SEQ ID NO: 10840 - protein, 5 aa, Artificial Sequence
  Description of Artificial Sequence: Synthetic peptide
SYDIN

SEQ ID NO: 10841 - protein, 5 aa, Artificial Sequence
  Description of Artificial Sequence: Synthetic peptide
SYDIN

SEQ ID NO: 10842 - protein, 5 aa, Artificial Sequence
  Description of Artificial Sequence: Synthetic peptide
SYSMN

SEQ ID NO: 10843 - protein, 5 aa, Artificial Sequence
  Description of Artificial Sequence: Synthetic peptide
GYSMN

SEQ ID NO: 10844 - protein, 5 aa, Artificial Sequence
  Description of Artificial Sequence: Synthetic peptide
SYAMH

SEQ ID NO: 10845 - protein, 5 aa, Artificial Sequence
  Description of Artificial Sequence: Synthetic peptide
RYGMQ

SEQ ID NO: 10846 - protein, 5 aa, Artificial Sequence
  Description of Artificial Sequence: Synthetic peptide
RYGMD

SEQ ID NO: 10847 - protein, 5 aa, Artificial Sequence
  Description of Artificial Sequence: Synthetic peptide
SYYWS

SEQ ID NO: 10848 - protein, 7 aa, Artificial Sequence
  Description of Artificial Sequence: Synthetic peptide
SSRYYWG

SEQ ID NO: 10849 - protein, 7 aa, Artificial Sequence
  Description of Artificial Sequence: Synthetic peptide
SSRYYWG

SEQ ID NO: 10850 - protein, 7 aa, Artificial Sequence
  Description of Artificial Sequence: Synthetic peptide
SSRYYWG

SEQ ID NO: 10851 - protein, 7 aa, Artificial Sequence
  Description of Artificial Sequence: Synthetic peptide
SSRYYWG

SEQ ID NO: 10852 - protein, 7 aa, Artificial Sequence
  Description of Artificial Sequence: Synthetic peptide
SNSAAWN

SEQ ID NO: 10853 - protein, 7 aa, Artificial Sequence
  Description of Artificial Sequence: Synthetic peptide
SNSAAWN

SEQ ID NO: 10854 - protein, 6 aa, Artificial Sequence
  Description of Artificial Sequence: Synthetic peptide
SGYYWG

SEQ ID NO: 10855 - protein, 7 aa, Artificial Sequence
  Description of Artificial Sequence: Synthetic peptide
SSRSYWG

SEQ ID NO: 10856 - protein, 7 aa, Artificial Sequence
  Description of Artificial Sequence: Synthetic peptide
TSGMRVS

SEQ ID NO: 10857 - protein, 7 aa, Artificial Sequence
  Description of Artificial Sequence: Synthetic peptide
THKMGVD

SEQ ID NO: 10858 - protein, 7 aa, Artificial Sequence
  Description of Artificial Sequence: Synthetic peptide
TNKMAVG

SEQ ID NO: 10859 - protein, 7 aa, Artificial Sequence
  Description of Artificial Sequence: Synthetic peptide
THKMGVD

SEQ ID NO: 10860 - protein, 5 aa, Artificial Sequence
  Description of Artificial Sequence: Synthetic peptide
SYAMS

SEQ ID NO: 10861 - protein, 5 aa, Artificial Sequence
  Description of Artificial Sequence: Synthetic peptide
IYALS

SEQ ID NO: 10862 - protein, 5 aa, Artificial Sequence
  Description of Artificial Sequence: Synthetic peptide
SYYWS

SEQ ID NO: 10863 - protein, 7 aa, Artificial Sequence
  Description of Artificial Sequence: Synthetic peptide
SSRSYWG

SEQ ID NO: 10864 - protein, 7 aa, Artificial Sequence
  Description of Artificial Sequence: Synthetic peptide
TSGVGVG

SEQ ID NO: 10865 - protein, 7 aa, Artificial Sequence
  Description of Artificial Sequence: Synthetic peptide
THKMGVD

SEQ ID NO: 10866 - protein, 7 aa, Artificial Sequence
  Description of Artificial Sequence: Synthetic peptide
THKMGVD

SEQ ID NO: 10867 - protein, 7 aa, Artificial Sequence
  Description of Artificial Sequence: Synthetic peptide
THKMGVD

SEQ ID NO: 10868 - protein, 7 aa, Artificial Sequence
  Description of Artificial Sequence: Synthetic peptide
THKMGVD

SEQ ID NO: 10869 - protein, 7 aa, Artificial Sequence
  Description of Artificial Sequence: Synthetic peptide
THKMGVD

SEQ ID NO: 10870 - protein, 7 aa, Artificial Sequence
  Description of Artificial Sequence: Synthetic peptide
THKMGVD

SEQ ID NO: 10871 - protein, 7 aa, Artificial Sequence
  Description of Artificial Sequence: Synthetic peptide
THKMGVD

SEQ ID NO: 10872 - protein, 7 aa, Artificial Sequence
  Description of Artificial Sequence: Synthetic peptide
THKMGVD

SEQ ID NO: 10873 - protein, 7 aa, Artificial Sequence
  Description of Artificial Sequence: Synthetic peptide
THKMGVD

SEQ ID NO: 10874 - protein, 7 aa, Artificial Sequence
  Description of Artificial Sequence: Synthetic peptide
THKMGVD

SEQ ID NO: 10875 - protein, 5 aa, Artificial Sequence
  Description of Artificial Sequence: Synthetic peptide
SYAMS

SEQ ID NO: 10876 - protein, 5 aa, Artificial Sequence
  Description of Artificial Sequence: Synthetic peptide
SYAMS

SEQ ID NO: 10877 - protein, 5 aa, Artificial Sequence
  Description of Artificial Sequence: Synthetic peptide
SYAVS

SEQ ID NO: 10878 - protein, 7 aa, Artificial Sequence
  Description of Artificial Sequence: Synthetic peptide
SGGYYWS

SEQ ID NO: 10879 - protein, 7 aa, Artificial Sequence
  Description of Artificial Sequence: Synthetic peptide
SGDYYWS

SEQ ID NO: 10880 - protein, 7 aa, Artificial Sequence
  Description of Artificial Sequence: Synthetic peptide
SNPYYWS

SEQ ID NO: 10881 - protein, 7 aa, Artificial Sequence
  Description of Artificial Sequence: Synthetic peptide
SNPYYWS

SEQ ID NO: 10882 - protein, 7 aa, Artificial Sequence
  Description of Artificial Sequence: Synthetic peptide
SNPYYWS

SEQ ID NO: 10883 - protein, 7 aa, Artificial Sequence
  Description of Artificial Sequence: Synthetic peptide
SGGYYWS

SEQ ID NO: 10884 - protein, 7 aa, Artificial Sequence
  Description of Artificial Sequence: Synthetic peptide
SNPYYWS

SEQ ID NO: 10885 - protein, 5 aa, Artificial Sequence
  Description of Artificial Sequence: Synthetic peptide
NAWMS

SEQ ID NO: 10886 - protein, 5 aa, Artificial Sequence
  Description of Artificial Sequence: Synthetic peptide
NAWMS

SEQ ID NO: 10887 - protein, 5 aa, Artificial Sequence
  Description of Artificial Sequence: Synthetic peptide
NAWMS

SEQ ID NO: 10888 - protein, 5 aa, Artificial Sequence
  Description of Artificial Sequence: Synthetic peptide
NAWMS

SEQ ID NO: 10889 - protein, 5 aa, Artificial Sequence
  Description of Artificial Sequence: Synthetic peptide
NAWMS

SEQ ID NO: 10890 - protein, 5 aa, Artificial Sequence
  Description of Artificial Sequence: Synthetic peptide
NAWMS

SEQ ID NO: 10891 - protein, 5 aa, Artificial Sequence
  Description of Artificial Sequence: Synthetic peptide
NAWMS

SEQ ID NO: 10892 - protein, 5 aa, Artificial Sequence
  Description of Artificial Sequence: Synthetic peptide
NAWMS

SEQ ID NO: 10893 - protein, 5 aa, Artificial Sequence
  Description of Artificial Sequence: Synthetic peptide
NAWMS

SEQ ID NO: 10894 - protein, 5 aa, Artificial Sequence
  Description of Artificial Sequence: Synthetic peptide
NAWMS

SEQ ID NO: 10895 - protein, 5 aa, Artificial Sequence
  Description of Artificial Sequence: Synthetic peptide
NAWMS

SEQ ID NO: 10896 - protein, 5 aa, Artificial Sequence
  Description of Artificial Sequence: Synthetic peptide
NAWMS

SEQ ID NO: 10897 - protein, 5 aa, Artificial Sequence
  Description of Artificial Sequence: Synthetic peptide
NAWMS

SEQ ID NO: 10898 - protein, 5 aa, Artificial Sequence
  Description of Artificial Sequence: Synthetic peptide
NAWMS

SEQ ID NO: 10899 - protein, 5 aa, Artificial Sequence
  Description of Artificial Sequence: Synthetic peptide
NAWMS

SEQ ID NO: 10900 - protein, 5 aa, Artificial Sequence
  Description of Artificial Sequence: Synthetic peptide
NAWMS

SEQ ID NO: 10901 - protein, 5 aa, Artificial Sequence
  Description of Artificial Sequence: Synthetic peptide
NAWMS

SEQ ID NO: 10902 - protein, 5 aa, Artificial Sequence
  Description of Artificial Sequence: Synthetic peptide
NAWMS

SEQ ID NO: 10903 - protein, 5 aa, Artificial Sequence
  Description of Artificial Sequence: Synthetic peptide
NAWMS

SEQ ID NO: 10904 - protein, 5 aa, Artificial Sequence
  Description of Artificial Sequence: Synthetic peptide
NAWMS

SEQ ID NO: 10905 - protein, 5 aa, Artificial Sequence
  Description of Artificial Sequence: Synthetic peptide
NAWMS

SEQ ID NO: 10906 - protein, 5 aa, Artificial Sequence
  Description of Artificial Sequence: Synthetic peptide
NAWMS

SEQ ID NO: 10907 - protein, 5 aa, Artificial Sequence
  Description of Artificial Sequence: Synthetic peptide
NAWMS

SEQ ID NO: 10908 - protein, 5 aa, Artificial Sequence
  Description of Artificial Sequence: Synthetic peptide
NAWMS

SEQ ID NO: 10909 - protein, 5 aa, Artificial Sequence
  Description of Artificial Sequence: Synthetic peptide
SYYWS

SEQ ID NO: 10910 - protein, 5 aa, Artificial Sequence
  Description of Artificial Sequence: Synthetic peptide
SYYWS

SEQ ID NO: 10911 - protein, 5 aa, Artificial Sequence
  Description of Artificial Sequence: Synthetic peptide
DFFWS

SEQ ID NO: 10912 - protein, 5 aa, Artificial Sequence
  Description of Artificial Sequence: Synthetic peptide
NYYWS

SEQ ID NO: 10913 - protein, 5 aa, Artificial Sequence
  Description of Artificial Sequence: Synthetic peptide
SYAMS

SEQ ID NO: 10914 - protein, 5 aa, Artificial Sequence
  Description of Artificial Sequence: Synthetic peptide
SYAMS

SEQ ID NO: 10915 - protein, 5 aa, Artificial Sequence
  Description of Artificial Sequence: Synthetic peptide
SHAMS

SEQ ID NO: 10916 - protein, 5 aa, Artificial Sequence
  Description of Artificial Sequence: Synthetic peptide
SYAMS

SEQ ID NO: 10917 - protein, 5 aa, Artificial Sequence
  Description of Artificial Sequence: Synthetic peptide
SYAMS

SEQ ID NO: 10918 - protein, 5 aa, Artificial Sequence
  Description of Artificial Sequence: Synthetic peptide
SHAMS

SEQ ID NO: 10919 - protein, 5 aa, Artificial Sequence
  Description of Artificial Sequence: Synthetic peptide
SYAMS

SEQ ID NO: 10920 - protein, 5 aa, Artificial Sequence
  Description of Artificial Sequence: Synthetic peptide
SHAMS

SEQ ID NO: 10921 - protein, 5 aa, Artificial Sequence
  Description of Artificial Sequence: Synthetic peptide
SYAMS

SEQ ID NO: 10922 - protein, 5 aa, Artificial Sequence
  Description of Artificial Sequence: Synthetic peptide
SYAMS

SEQ ID NO: 10923 - protein, 5 aa, Artificial Sequence
  Description of Artificial Sequence: Synthetic peptide
SYAMN

SEQ ID NO: 10924 - protein, 5 aa, Artificial Sequence
  Description of Artificial Sequence: Synthetic peptide
SYAMS

SEQ ID NO: 10925 - protein, 5 aa, Artificial Sequence
  Description of Artificial Sequence: Synthetic peptide
SHAMS

SEQ ID NO: 10926 - protein, 5 aa, Artificial Sequence
  Description of Artificial Sequence: Synthetic peptide
SYAMS

SEQ ID NO: 10927 - protein, 5 aa, Artificial Sequence
  Description of Artificial Sequence: Synthetic peptide
SYAMS

SEQ ID NO: 10928 - protein, 5 aa, Artificial Sequence
  Description of Artificial Sequence: Synthetic peptide
SYAMS

SEQ ID NO: 10929 - protein, 5 aa, Artificial Sequence
  Description of Artificial Sequence: Synthetic peptide
SYAMS

SEQ ID NO: 10930 - protein, 5 aa, Artificial Sequence
  Description of Artificial Sequence: Synthetic peptide
SYAMS

SEQ ID NO: 10931 - protein, 5 aa, Artificial Sequence
  Description of Artificial Sequence: Synthetic peptide
SYAMS

SEQ ID NO: 10932 - protein, 5 aa, Artificial Sequence
  Description of Artificial Sequence: Synthetic peptide
SYAMS

SEQ ID NO: 10933 - protein, 5 aa, Artificial Sequence
  Description of Artificial Sequence: Synthetic peptide
SYAMN

SEQ ID NO: 10934 - protein, 5 aa, Artificial Sequence
  Description of Artificial Sequence: Synthetic peptide
SYAMS

SEQ ID NO: 10935 - protein, 5 aa, Artificial Sequence
  Description of Artificial Sequence: Synthetic peptide
SYAMS

SEQ ID NO: 10936 - protein, 5 aa, Artificial Sequence
  Description of Artificial Sequence: Synthetic peptide
SYAMS

SEQ ID NO: 10937 - protein, 5 aa, Artificial Sequence
  Description of Artificial Sequence: Synthetic peptide
SYAMS

SEQ ID NO: 10938 - protein, 5 aa, Artificial Sequence
  Description of Artificial Sequence: Synthetic peptide
SYAMS

SEQ ID NO: 10939 - protein, 5 aa, Artificial Sequence
  Description of Artificial Sequence: Synthetic peptide
SYAMS

SEQ ID NO: 10940 - protein, 5 aa, Artificial Sequence
  Description of Artificial Sequence: Synthetic peptide
SYAMS

SEQ ID NO: 10941 - protein, 5 aa, Artificial Sequence
  Description of Artificial Sequence: Synthetic peptide
SYAMH

SEQ ID NO: 10942 - protein, 5 aa, Artificial Sequence
  Description of Artificial Sequence: Synthetic peptide
SYAMT

SEQ ID NO: 10943 - protein, 5 aa, Artificial Sequence
  Description of Artificial Sequence: Synthetic peptide
SYAMS

SEQ ID NO: 10944 - protein, 5 aa, Artificial Sequence
  Description of Artificial Sequence: Synthetic peptide
SYAMS

SEQ ID NO: 10945 - protein, 5 aa, Artificial Sequence
  Description of Artificial Sequence: Synthetic peptide
SYAMS

SEQ ID NO: 10946 - protein, 5 aa, Artificial Sequence
  Description of Artificial Sequence: Synthetic peptide
SHAMS

SEQ ID NO: 10947 - protein, 5 aa, Artificial Sequence
  Description of Artificial Sequence: Synthetic peptide
SHAMS

SEQ ID NO: 10948 - protein, 5 aa, Artificial Sequence
  Description of Artificial Sequence: Synthetic peptide
SHAMS

SEQ ID NO: 10949 - protein, 5 aa, Artificial Sequence
  Description of Artificial Sequence: Synthetic peptide
SYAMS

SEQ ID NO: 10950 - protein, 5 aa, Artificial Sequence
  Description of Artificial Sequence: Synthetic peptide
SYAMS

SEQ ID NO: 10951 - protein, 5 aa, Artificial Sequence
  Description of Artificial Sequence: Synthetic peptide
SHAMS

SEQ ID NO: 10952 - protein, 5 aa, Artificial Sequence
  Description of Artificial Sequence: Synthetic peptide
SYAMS

SEQ ID NO: 10953 - protein, 5 aa, Artificial Sequence
  Description of Artificial Sequence: Synthetic peptide
SYAMN

SEQ ID NO: 10954 - protein, 5 aa, Artificial Sequence
  Description of Artificial Sequence: Synthetic peptide
SHAMS

SEQ ID NO: 10955 - protein, 5 aa, Artificial Sequence
  Description of Artificial Sequence: Synthetic peptide
SYAMS

SEQ ID NO: 10956 - protein, 5 aa, Artificial Sequence
  Description of Artificial Sequence: Synthetic peptide
SYAMS

SEQ ID NO: 10957 - protein, 5 aa, Artificial Sequence
  Description of Artificial Sequence: Synthetic peptide
SYAMT

SEQ ID NO: 10958 - protein, 5 aa, Artificial Sequence
  Description of Artificial Sequence: Synthetic peptide
SHAMS

SEQ ID NO: 10959 - protein, 5 aa, Artificial Sequence
  Description of Artificial Sequence: Synthetic peptide
SYAMS

SEQ ID NO: 10960 - protein, 5 aa, Artificial Sequence
  Description of Artificial Sequence: Synthetic peptide
SYAMS

SEQ ID NO: 10961 - protein, 5 aa, Artificial Sequence
  Description of Artificial Sequence: Synthetic peptide
SHAMS

SEQ ID NO: 10962 - protein, 5 aa, Artificial Sequence
  Description of Artificial Sequence: Synthetic peptide
SHAMS

SEQ ID NO: 10963 - protein, 5 aa, Artificial Sequence
  Description of Artificial Sequence: Synthetic peptide
SHAMS

SEQ ID NO: 10964 - protein, 5 aa, Artificial Sequence
  Description of Artificial Sequence: Synthetic peptide
SHAMS

SEQ ID NO: 10965 - protein, 5 aa, Artificial Sequence
  Description of Artificial Sequence: Synthetic peptide
SYAMS

SEQ ID NO: 10966 - protein, 5 aa, Artificial Sequence
  Description of Artificial Sequence: Synthetic peptide
SYAMS

SEQ ID NO: 10967 - protein, 5 aa, Artificial Sequence
  Description of Artificial Sequence: Synthetic peptide
SYAMS

SEQ ID NO: 10968 - protein, 5 aa, Artificial Sequence
  Description of Artificial Sequence: Synthetic peptide
SYAMS

SEQ ID NO: 10969 - protein, 5 aa, Artificial Sequence
  Description of Artificial Sequence: Synthetic peptide
SHAMS

SEQ ID NO: 10970 - protein, 5 aa, Artificial Sequence
  Description of Artificial Sequence: Synthetic peptide
SHAMS

SEQ ID NO: 10971 - protein, 5 aa, Artificial Sequence
  Description of Artificial Sequence: Synthetic peptide
SYAMS

SEQ ID NO: 10972 - protein, 5 aa, Artificial Sequence
  Description of Artificial Sequence: Synthetic peptide
SYAMS

SEQ ID NO: 10973 - protein, 5 aa, Artificial Sequence
  Description of Artificial Sequence: Synthetic peptide
SYAMH

SEQ ID NO: 10974 - protein, 5 aa, Artificial Sequence
  Description of Artificial Sequence: Synthetic peptide
TYGMH

SEQ ID NO: 10975 - protein, 5 aa, Artificial Sequence
  Description of Artificial Sequence: Synthetic peptide
TYGMH

SEQ ID NO: 10976 - protein, 5 aa, Artificial Sequence
  Description of Artificial Sequence: Synthetic peptide
TYGMH

SEQ ID NO: 10977 - protein, 5 aa, Artificial Sequence
  Description of Artificial Sequence: Synthetic peptide
SYGIS

SEQ ID NO: 10978 - protein, 5 aa, Artificial Sequence
  Description of Artificial Sequence: Synthetic peptide
RNGLS

SEQ ID NO: 10979 - protein, 5 aa, Artificial Sequence
  Description of Artificial Sequence: Synthetic peptide
RNGLS

SEQ ID NO: 10980 - protein, 5 aa, Artificial Sequence
  Description of Artificial Sequence: Synthetic peptide
DYYMS

SEQ ID NO: 10981 - protein, 5 aa, Artificial Sequence
  Description of Artificial Sequence: Synthetic peptide
DYYMS

SEQ ID NO: 10982 - protein, 5 aa, Artificial Sequence
  Description of Artificial Sequence: Synthetic peptide
DYYMS

SEQ ID NO: 10983 - protein, 15 aa, Artificial Sequence
  Description of Artificial Sequence: Synthetic peptide
WYQQKPGQPPKLLIY

SEQ ID NO: 10984 - protein, 15 aa, Artificial Sequence
  Description of Artificial Sequence: Synthetic peptide
WYQQKPGQSPKLLIY

SEQ ID NO: 10985 - protein, 15 aa, Artificial Sequence
  Description of Artificial Sequence: Synthetic peptide
WYQQKPGQPPKLLIY

SEQ ID NO: 10986 - protein, 15 aa, Artificial Sequence
  Description of Artificial Sequence: Synthetic peptide
WYQQKPGQPPKLLIY

SEQ ID NO: 10987 - protein, 15 aa, Artificial Sequence
  Description of Artificial Sequence: Synthetic peptide
WYQQKPDQSPKLLIK

SEQ ID NO: 10988 - protein, 15 aa, Artificial Sequence
  Description of Artificial Sequence: Synthetic peptide
WYQQKLGSSPKLWIY

SEQ ID NO: 10989 - protein, 15 aa, Artificial Sequence
  Description of Artificial Sequence: Synthetic peptide
WYQQKPGKAPKLLIY

SEQ ID NO: 10990 - protein, 15 aa, Artificial Sequence
  Description of Artificial Sequence: Synthetic peptide
WYQQKQGKSPQLLVY

SEQ ID NO: 10991 - protein, 15 aa, Artificial Sequence
  Description of Artificial Sequence: Synthetic peptide
WYLQKPGQSPQLLIY

SEQ ID NO: 10992 - protein, 15 aa, Artificial Sequence
  Description of Artificial Sequence: Synthetic peptide
WYLQKPGQSPQLLIY

SEQ ID NO: 10993 - protein, 15 aa, Artificial Sequence
  Description of Artificial Sequence: Synthetic peptide
WYLQKPGQSPQLLIY

SEQ ID NO: 10994 - protein, 15 aa, Artificial Sequence
  Description of Artificial Sequence: Synthetic peptide
WYLQKPGQSPQLLIY

SEQ ID NO: 10995 - protein, 15 aa, Artificial Sequence
  Description of Artificial Sequence: Synthetic peptide
WYLQKPGQSPQLLIY

SEQ ID NO: 10996 - protein, 15 aa, Artificial Sequence
  Description of Artificial Sequence: Synthetic peptide
WYLQKPGQSPQLLIY

SEQ ID NO: 10997 - protein, 15 aa, Artificial Sequence
  Description of Artificial Sequence: Synthetic peptide
WYLQKPGQSPQLLIY

SEQ ID NO: 10998 - protein, 15 aa, Artificial Sequence
  Description of Artificial Sequence: Synthetic peptide
WYLQKPGQSPQLLIY

SEQ ID NO: 10999 - protein, 15 aa, Artificial Sequence
  Description of Artificial Sequence: Synthetic peptide
WYLQKPGQSPQLLIY

SEQ ID NO: 11000 - protein, 15 aa, Artificial Sequence
  Description of Artificial Sequence: Synthetic peptide
WYLQKPGQSPQLLIY

SEQ ID NO: 11001 - protein, 15 aa, Artificial Sequence
  Description of Artificial Sequence: Synthetic peptide
WYLQKPGQSPQLLIY

SEQ ID NO: 11002 - protein, 15 aa, Artificial Sequence
  Description of Artificial Sequence: Synthetic peptide
WYLQKPGQSPQLLIY

SEQ ID NO: 11003 - protein, 15 aa, Artificial Sequence
  Description of Artificial Sequence: Synthetic peptide
WYLQKPGQSPQLLIY

SEQ ID NO: 11004 - protein, 15 aa, Artificial Sequence
  Description of Artificial Sequence: Synthetic peptide
WYLQKPGQSPQLLIY

SEQ ID NO: 11005 - protein, 15 aa, Artificial Sequence
  Description of Artificial Sequence: Synthetic peptide
WYLHKPGQSPQLLIY

SEQ ID NO: 11006 - protein, 15 aa, Artificial Sequence
  Description of Artificial Sequence: Synthetic peptide
WYLQKPGQSPQLLIY

SEQ ID NO: 11007 - protein, 15 aa, Artificial Sequence
  Description of Artificial Sequence: Synthetic peptide
WYLQKPGQSPQLLIY

SEQ ID NO: 11008 - protein, 15 aa, Artificial Sequence
  Description of Artificial Sequence: Synthetic peptide
WYLQKPGQSPQLLIY

SEQ ID NO: 11009 - protein, 15 aa, Artificial Sequence
  Description of Artificial Sequence: Synthetic peptide
WYLQKPGQSPQLLIY

SEQ ID NO: 11010 - protein, 15 aa, Artificial Sequence
  Description of Artificial Sequence: Synthetic peptide
WYLQKPGQSPQLLIY

SEQ ID NO: 11011 - protein, 15 aa, Artificial Sequence
  Description of Artificial Sequence: Synthetic peptide
WYQQKPGQAPRLLIY

SEQ ID NO: 11012 - protein, 15 aa, Artificial Sequence
  Description of Artificial Sequence: Synthetic peptide
WYQQKPGQAPRLLIY

SEQ ID NO: 11013 - protein, 15 aa, Artificial Sequence
  Description of Artificial Sequence: Synthetic peptide
WYQQKPGQAPRLLIY

SEQ ID NO: 11014 - protein, 15 aa, Artificial Sequence
  Description of Artificial Sequence: Synthetic peptide
WYQQKPGQAPRLLIY

SEQ ID NO: 11015 - protein, 15 aa, Artificial Sequence
  Description of Artificial Sequence: Synthetic peptide
WYQQKPGQAPRLLIY

SEQ ID NO: 11016 - protein, 15 aa, Artificial Sequence
  Description of Artificial Sequence: Synthetic peptide
WYQQKPGQAPRLLIY

SEQ ID NO: 11017 - protein, 15 aa, Artificial Sequence
  Description of Artificial Sequence: Synthetic peptide
WYQQKPGQAPRLLIY

SEQ ID NO: 11018 - protein, 15 aa, Artificial Sequence
  Description of Artificial Sequence: Synthetic peptide
WYQQKPGQAPRLLIY

SEQ ID NO: 11019 - protein, 15 aa, Artificial Sequence
  Description of Artificial Sequence: Synthetic peptide
WYQQKPGQAPRLLIY

SEQ ID NO: 11020 - protein, 15 aa, Artificial Sequence
  Description of Artificial Sequence: Synthetic peptide
WYLQKPGQSPQLLIY

SEQ ID NO: 11021 - protein, 15 aa, Artificial Sequence
  Description of Artificial Sequence: Synthetic peptide
WYLQKPGQSPQLLIY

SEQ ID NO: 11022 - protein, 15 aa, Artificial Sequence
  Description of Artificial Sequence: Synthetic peptide
WYLQKPGQSPQLLIF

SEQ ID NO: 11023 - protein, 15 aa, Artificial Sequence
  Description of Artificial Sequence: Synthetic peptide
WYLQKPGQSPQLLIY

SEQ ID NO: 11024 - protein, 15 aa, Artificial Sequence
  Description of Artificial Sequence: Synthetic peptide
WYLQKPGQSPQLLIY

SEQ ID NO: 11025 - protein, 15 aa, Artificial Sequence
  Description of Artificial Sequence: Synthetic peptide
WYLQKPGQSPQLLIY

SEQ ID NO: 11026 - protein, 15 aa, Artificial Sequence
  Description of Artificial Sequence: Synthetic peptide
WYLQKPGQSPQLLIY

SEQ ID NO: 11027 - protein, 15 aa, Artificial Sequence
  Description of Artificial Sequence: Synthetic peptide
WYLQKPGQSPQLLIY

SEQ ID NO: 11028 - protein, 15 aa, Artificial Sequence
  Description of Artificial Sequence: Synthetic peptide
WYLQKPGQSPQLLIY

SEQ ID NO: 11029 - protein, 15 aa, Artificial Sequence
  Description of Artificial Sequence: Synthetic peptide
WYLQKPGQSPQLLIY

SEQ ID NO: 11030 - protein, 15 aa, Artificial Sequence
  Description of Artificial Sequence: Synthetic peptide
WYLQKPGQSPQLLIY

SEQ ID NO: 11031 - protein, 15 aa, Artificial Sequence
  Description of Artificial Sequence: Synthetic peptide
WYLQKPGQSPQLLIY

SEQ ID NO: 11032 - protein, 15 aa, Artificial Sequence
  Description of Artificial Sequence: Synthetic peptide
WYQQKPGKAPKLLIY

SEQ ID NO: 11033 - protein, 15 aa, Artificial Sequence
  Description of Artificial Sequence: Synthetic peptide
WYQQKPGKAPKLLIY

SEQ ID NO: 11034 - protein, 15 aa, Artificial Sequence
  Description of Artificial Sequence: Synthetic peptide
WYQQKPGKAPKLLIY

SEQ ID NO: 11035 - protein, 15 aa, Artificial Sequence
  Description of Artificial Sequence: Synthetic peptide
WYLQKPGQSPQLLIY

SEQ ID NO: 11036 - protein, 15 aa, Artificial Sequence
  Description of Artificial Sequence: Synthetic peptide
WYLQKPGQSPQLLIY

SEQ ID NO: 11037 - protein, 15 aa, Artificial Sequence
  Description of Artificial Sequence: Synthetic peptide
WYLQKPGQSPQLLIY

SEQ ID NO: 11038 - protein, 15 aa, Artificial Sequence
  Description of Artificial Sequence: Synthetic peptide
WYLQKPGQSPHLLIY

SEQ ID NO: 11039 - protein, 15 aa, Artificial Sequence
  Description of Artificial Sequence: Synthetic peptide
WYLQKPGQSPQLLIY

SEQ ID NO: 11040 - protein, 15 aa, Artificial Sequence
  Description of Artificial Sequence: Synthetic peptide
WYLQKPGQSPQLLIY

SEQ ID NO: 11041 - protein, 15 aa, Artificial Sequence
  Description of Artificial Sequence: Synthetic peptide
WYLQKPGQSPQLLIY

SEQ ID NO: 11042 - protein, 15 aa, Artificial Sequence
  Description of Artificial Sequence: Synthetic peptide
WYLQKPGQSPQLLIY

SEQ ID NO: 11043 - protein, 15 aa, Artificial Sequence
  Description of Artificial Sequence: Synthetic peptide
WYLQKPGQSPQLLIY

SEQ ID NO: 11044 - protein, 15 aa, Artificial Sequence
  Description of Artificial Sequence: Synthetic peptide
WYQQKPGKAPKLLIY

SEQ ID NO: 11045 - protein, 15 aa, Artificial Sequence
  Description of Artificial Sequence: Synthetic peptide
WYQQKPGKAPKLLIY

SEQ ID NO: 11046 - protein, 15 aa, Artificial Sequence
  Description of Artificial Sequence: Synthetic peptide
WYQQKPGKAPKLLIY

SEQ ID NO: 11047 - protein, 15 aa, Artificial Sequence
  Description of Artificial Sequence: Synthetic peptide
WYQQKPGKAPKLLIY

SEQ ID NO: 11048 - protein, 15 aa, Artificial Sequence
  Description of Artificial Sequence: Synthetic peptide
WYQQKPGKAPKLLIY

SEQ ID NO: 11049 - protein, 15 aa, Artificial Sequence
  Description of Artificial Sequence: Synthetic peptide
WYQQKPGKAPKLLIY

SEQ ID NO: 11050 - protein, 15 aa, Artificial Sequence
  Description of Artificial Sequence: Synthetic peptide
WYQQKPGKAPKLLIY

SEQ ID NO: 11051 - protein, 15 aa, Artificial Sequence
  Description of Artificial Sequence: Synthetic peptide
WYQQKPGKAPKLLIY

SEQ ID NO: 11052 - protein, 15 aa, Artificial Sequence
  Description of Artificial Sequence: Synthetic peptide
WYLQKPGQSPQLLIY

SEQ ID NO: 11053 - protein, 15 aa, Artificial Sequence
  Description of Artificial Sequence: Synthetic peptide
WYLQKPGQSPQLLIY

SEQ ID NO: 11054 - protein, 15 aa, Artificial Sequence
  Description of Artificial Sequence: Synthetic peptide
WYLQKPGQSPQLLIY

SEQ ID NO: 11055 - protein, 15 aa, Artificial Sequence
  Description of Artificial Sequence: Synthetic peptide
WYLQKPGQSPQLLIY

SEQ ID NO: 11056 - protein, 15 aa, Artificial Sequence
  Description of Artificial Sequence: Synthetic peptide
WYLQKPGQSPQLLIY

SEQ ID NO: 11057 - protein, 15 aa, Artificial Sequence
  Description of Artificial Sequence: Synthetic peptide
WYLQKPGQSPQLLIY

SEQ ID NO: 11058 - protein, 15 aa, Artificial Sequence
  Description of Artificial Sequence: Synthetic peptide
WYLQKPGQSPQLLIY

SEQ ID NO: 11059 - protein, 15 aa, Artificial Sequence
  Description of Artificial Sequence: Synthetic peptide
WYLQKPGQSPQLLIY

SEQ ID NO: 11060 - protein, 15 aa, Artificial Sequence
  Description of Artificial Sequence: Synthetic peptide
WYLQKPGQSPQLLIY

SEQ ID NO: 11061 - protein, 15 aa, Artificial Sequence
  Description of Artificial Sequence: Synthetic peptide
WYLHKPGQSPQLLIY

SEQ ID NO: 11062 - protein, 15 aa, Artificial Sequence
  Description of Artificial Sequence: Synthetic peptide
WYLQKPGQSPQLLIY

SEQ ID NO: 11063 - protein, 15 aa, Artificial Sequence
  Description of Artificial Sequence: Synthetic peptide
WYLQKPGQSPQLLIY

SEQ ID NO: 11064 - protein, 15 aa, Artificial Sequence
  Description of Artificial Sequence: Synthetic peptide
WYLQKPGQSPQLLIY

SEQ ID NO: 11065 - protein, 15 aa, Artificial Sequence
  Description of Artificial Sequence: Synthetic peptide
WYLQKPGQSPQLLIY

SEQ ID NO: 11066 - protein, 15 aa, Artificial Sequence
  Description of Artificial Sequence: Synthetic peptide
WYLQKPGQSPQLLIY

SEQ ID NO: 11067 - protein, 15 aa, Artificial Sequence
  Description of Artificial Sequence: Synthetic peptide
WYLQKPGQSPQLLIY

SEQ ID NO: 11068 - protein, 15 aa, Artificial Sequence
  Description of Artificial Sequence: Synthetic peptide
WYLQKPGQSPQLLIY

SEQ ID NO: 11069 - protein, 15 aa, Artificial Sequence
  Description of Artificial Sequence: Synthetic peptide
WYQQKPGKVPKLLIY

SEQ ID NO: 11070 - protein, 15 aa, Artificial Sequence
  Description of Artificial Sequence: Synthetic peptide
WYQQKPGKVPKLLIY

SEQ ID NO: 11071 - protein, 15 aa, Artificial Sequence
  Description of Artificial Sequence: Synthetic peptide
WYQQKPGKVPNLLIY

SEQ ID NO: 11072 - protein, 15 aa, Artificial Sequence
  Description of Artificial Sequence: Synthetic peptide
WYQQKPGKVPKLLIY

SEQ ID NO: 11073 - protein, 15 aa, Artificial Sequence
  Description of Artificial Sequence: Synthetic peptide
WYQQKPGKVPKLLIS

SEQ ID NO: 11074 - protein, 15 aa, Artificial Sequence
  Description of Artificial Sequence: Synthetic peptide
WYQQKPGKVPKLLIY

SEQ ID NO: 11075 - protein, 15 aa, Artificial Sequence
  Description of Artificial Sequence: Synthetic peptide
WYQQKPGKVPKLLIY

SEQ ID NO: 11076 - protein, 15 aa, Artificial Sequence
  Description of Artificial Sequence: Synthetic peptide
WYLQKPGQSPQLLIY

SEQ ID NO: 11077 - protein, 15 aa, Artificial Sequence
  Description of Artificial Sequence: Synthetic peptide
WYLQKPGQSPQLLIY

SEQ ID NO: 11078 - protein, 15 aa, Artificial Sequence
  Description of Artificial Sequence: Synthetic peptide
WYQQKPGKVPKLLIY

SEQ ID NO: 11079 - protein, 15 aa, Artificial Sequence
  Description of Artificial Sequence: Synthetic peptide
WYQQKPGKVPKLLIY

SEQ ID NO: 11080 - protein, 15 aa, Artificial Sequence
  Description of Artificial Sequence: Synthetic peptide
WYLQKPGQSPQLLIY

SEQ ID NO: 11081 - protein, 15 aa, Artificial Sequence
  Description of Artificial Sequence: Synthetic peptide
WYLQKPGQSPQLLIY

SEQ ID NO: 11082 - protein, 15 aa, Artificial Sequence
  Description of Artificial Sequence: Synthetic peptide
WYQQKPGQPPKLLIY

SEQ ID NO: 11083 - protein, 15 aa, Artificial Sequence
  Description of Artificial Sequence: Synthetic peptide
WYQQKPGQPPKLLIY

SEQ ID NO: 11084 - protein, 15 aa, Artificial Sequence
  Description of Artificial Sequence: Synthetic peptide
WYQQKPGQPPKLLIY

SEQ ID NO: 11085 - protein, 15 aa, Artificial Sequence
  Description of Artificial Sequence: Synthetic peptide
WYQQKPGQPPKLLIY

SEQ ID NO: 11086 - protein, 15 aa, Artificial Sequence
  Description of Artificial Sequence: Synthetic peptide
WYQQKPGKAPKLLIY

SEQ ID NO: 11087 - protein, 15 aa, Artificial Sequence
  Description of Artificial Sequence: Synthetic peptide
WYQQKPGKAPKLLIY

SEQ ID NO: 11088 - protein, 15 aa, Artificial Sequence
  Description of Artificial Sequence: Synthetic peptide
WYQQKPGQPPKLLIY

SEQ ID NO: 11089 - protein, 15 aa, Artificial Sequence
  Description of Artificial Sequence: Synthetic peptide
WYQQKPGQPPKLLIY

SEQ ID NO: 11090 - protein, 15 aa, Artificial Sequence
  Description of Artificial Sequence: Synthetic peptide
WYQQKPGQPPKLLIY

SEQ ID NO: 11091 - protein, 15 aa, Artificial Sequence
  Description of Artificial Sequence: Synthetic peptide
WYQQKPGQPPKLLIY

SEQ ID NO: 11092 - protein, 15 aa, Artificial Sequence
  Description of Artificial Sequence: Synthetic peptide
WYQQKPGQPPKLLIY

SEQ ID NO: 11093 - protein, 15 aa, Artificial Sequence
  Description of Artificial Sequence: Synthetic peptide
WYQQKPGKAPKLLIY

SEQ ID NO: 11094 - protein, 15 aa, Artificial Sequence
  Description of Artificial Sequence: Synthetic peptide
WYQQKPGKAPKLLIY

SEQ ID NO: 11095 - protein, 15 aa, Artificial Sequence
  Description of Artificial Sequence: Synthetic peptide
WYQQKPGKAPKLLIY

SEQ ID NO: 11096 - protein, 15 aa, Artificial Sequence
  Description of Artificial Sequence: Synthetic peptide
WYQQKPGRAPKLLIF

SEQ ID NO: 11097 - protein, 15 aa, Artificial Sequence
  Description of Artificial Sequence: Synthetic peptide
WYQQKPGKAPKLLIY

SEQ ID NO: 11098 - protein, 15 aa, Artificial Sequence
  Description of Artificial Sequence: Synthetic peptide
WYQQKPGKAPKLLIY

SEQ ID NO: 11099 - protein, 15 aa, Artificial Sequence
  Description of Artificial Sequence: Synthetic peptide
WYQQKPGRAPKLLIF

SEQ ID NO: 11100 - protein, 15 aa, Artificial Sequence
  Description of Artificial Sequence: Synthetic peptide
WYQQKPGRAPKLLIF

SEQ ID NO: 11101 - protein, 15 aa, Artificial Sequence
  Description of Artificial Sequence: Synthetic peptide
WYQQKPGRAPKLLIF

SEQ ID NO: 11102 - protein, 15 aa, Artificial Sequence
  Description of Artificial Sequence: Synthetic peptide
WYQQKPGRAPKLLIF

SEQ ID NO: 11103 - protein, 15 aa, Artificial Sequence
  Description of Artificial Sequence: Synthetic peptide
WYQQKPGKAPKLLIY

SEQ ID NO: 11104 - protein, 15 aa, Artificial Sequence
  Description of Artificial Sequence: Synthetic peptide
WYQQKPGKAPKLLIY

SEQ ID NO: 11105 - protein, 15 aa, Artificial Sequence
  Description of Artificial Sequence: Synthetic peptide
WYQQKPGKAPKLLIY

SEQ ID NO: 11106 - protein, 15 aa, Artificial Sequence
  Description of Artificial Sequence: Synthetic peptide
WYQQKPGKAPKLLIY

SEQ ID NO: 11107 - protein, 15 aa, Artificial Sequence
  Description of Artificial Sequence: Synthetic peptide
WYQQKPGRAPKLLIF

SEQ ID NO: 11108 - protein, 15 aa, Artificial Sequence
  Description of Artificial Sequence: Synthetic peptide
WYQQKPGKAPKLLIY

SEQ ID NO: 11109 - protein, 15 aa, Artificial Sequence
  Description of Artificial Sequence: Synthetic peptide
WYQQKPGKAPKLLIY

SEQ ID NO: 11110 - protein, 15 aa, Artificial Sequence
  Description of Artificial Sequence: Synthetic peptide
WFQQKPGRAPKLLIF

SEQ ID NO: 11111 - protein, 15 aa, Artificial Sequence
  Description of Artificial Sequence: Synthetic peptide
WFQQKPGKAPKLLIY

SEQ ID NO: 11112 - protein, 15 aa, Artificial Sequence
  Description of Artificial Sequence: Synthetic peptide
WYQQKPGRAPKLLIF

SEQ ID NO: 11113 - protein, 15 aa, Artificial Sequence
  Description of Artificial Sequence: Synthetic peptide
WFQQKPGKAPKLLIF

SEQ ID NO: 11114 - protein, 15 aa, Artificial Sequence
  Description of Artificial Sequence: Synthetic peptide
WYQQKPGRAPKLLIF

SEQ ID NO: 11115 - protein, 15 aa, Artificial Sequence
  Description of Artificial Sequence: Synthetic peptide
WYQQKPGKAPKLLIY

SEQ ID NO: 11116 - protein, 15 aa, Artificial Sequence
  Description of Artificial Sequence: Synthetic peptide
WYQQKPGKAPKLLIY

SEQ ID NO: 11117 - protein, 15 aa, Artificial Sequence
  Description of Artificial Sequence: Synthetic peptide
WYQQKPGKAPKLLIY

SEQ ID NO: 11118 - protein, 15 aa, Artificial Sequence
  Description of Artificial Sequence: Synthetic peptide
WYQQKPGRAPKLLIF

SEQ ID NO: 11119 - protein, 15 aa, Artificial Sequence
  Description of Artificial Sequence: Synthetic peptide
WFQQKPGKAPKLLIF

SEQ ID NO: 11120 - protein, 15 aa, Artificial Sequence
  Description of Artificial Sequence: Synthetic peptide
WFQQKPGKAPKLLIF

SEQ ID NO: 11121 - protein, 15 aa, Artificial Sequence
  Description of Artificial Sequence: Synthetic peptide
WYQQKPGRAPKLLIF

SEQ ID NO: 11122 - protein, 15 aa, Artificial Sequence
  Description of Artificial Sequence: Synthetic peptide
WYQQKPGRAPKLLIF

SEQ ID NO: 11123 - protein, 15 aa, Artificial Sequence
  Description of Artificial Sequence: Synthetic peptide
WYQQKPGRAPKLLIF

SEQ ID NO: 11124 - protein, 15 aa, Artificial Sequence
  Description of Artificial Sequence: Synthetic peptide
WYQQKPGRAPKLLIF

SEQ ID NO: 11125 - protein, 15 aa, Artificial Sequence
  Description of Artificial Sequence: Synthetic peptide
WYQQKPGRAPKLLIF

SEQ ID NO: 11126 - protein, 15 aa, Artificial Sequence
  Description of Artificial Sequence: Synthetic peptide
WYQQKPGKAPKLLIY

SEQ ID NO: 11127 - protein, 15 aa, Artificial Sequence
  Description of Artificial Sequence: Synthetic peptide
WYQQKPGRAPKLLIF

SEQ ID NO: 11128 - protein, 15 aa, Artificial Sequence
  Description of Artificial Sequence: Synthetic peptide
WYQQKPGRAPKLLIF

SEQ ID NO: 11129 - protein, 15 aa, Artificial Sequence
  Description of Artificial Sequence: Synthetic peptide
WYQQKPGRAPKLLIF

SEQ ID NO: 11130 - protein, 15 aa, Artificial Sequence
  Description of Artificial Sequence: Synthetic peptide
WYQQKPGKAPKLLIY

SEQ ID NO: 11131 - protein, 15 aa, Artificial Sequence
  Description of Artificial Sequence: Synthetic peptide
WYQQKPGKAPKLLIY

SEQ ID NO: 11132 - protein, 15 aa, Artificial Sequence
  Description of Artificial Sequence: Synthetic peptide
WYQQKPGQAPRLLIY

SEQ ID NO: 11133 - protein, 15 aa, Artificial Sequence
  Description of Artificial Sequence: Synthetic peptide
WYLQKPGQSPQLLIY

SEQ ID NO: 11134 - protein, 15 aa, Artificial Sequence
  Description of Artificial Sequence: Synthetic peptide
WYQQKPGKVPKLLIY

SEQ ID NO: 11135 - protein, 15 aa, Artificial Sequence
  Description of Artificial Sequence: Synthetic peptide
WYQQKPGKVPKLLIS

SEQ ID NO: 11136 - protein, 15 aa, Artificial Sequence
  Description of Artificial Sequence: Synthetic peptide
WYQQKPGQPPKLLIY

SEQ ID NO: 11137 - protein, 15 aa, Artificial Sequence
  Description of Artificial Sequence: Synthetic peptide
WYQQKPGQPPKLLIY

SEQ ID NO: 11138 - protein, 15 aa, Artificial Sequence
  Description of Artificial Sequence: Synthetic peptide
WYQQKPGQPPKLLIY

SEQ ID NO: 11139 - protein, 15 aa, Artificial Sequence
  Description of Artificial Sequence: Synthetic peptide
WYQQKPGKAPKLLIY

SEQ ID NO: 11140 - protein, 15 aa, Artificial Sequence
  Description of Artificial Sequence: Synthetic peptide
WYQQKPGKAPKLLIY

SEQ ID NO: 11141 - protein, 15 aa, Artificial Sequence
  Description of Artificial Sequence: Synthetic peptide
WYQQHPGKAPKLMIY

SEQ ID NO: 11142 - protein, 15 aa, Artificial Sequence
  Description of Artificial Sequence: Synthetic peptide
WYQQHPGKAPKLMIY

SEQ ID NO: 11143 - protein, 15 aa, Artificial Sequence
  Description of Artificial Sequence: Synthetic peptide
WYQQLPGTAPKLLIY

SEQ ID NO: 11144 - protein, 15 aa, Artificial Sequence
  Description of Artificial Sequence: Synthetic peptide
WYQHLPGTAPKLLIY

SEQ ID NO: 11145 - protein, 15 aa, Artificial Sequence
  Description of Artificial Sequence: Synthetic peptide
WLQQHQGHPPKLLSY

SEQ ID NO: 11146 - protein, 15 aa, Artificial Sequence
  Description of Artificial Sequence: Synthetic peptide
WLQQHQGHPPKLLSY

SEQ ID NO: 11147 - protein, 15 aa, Artificial Sequence
  Description of Artificial Sequence: Synthetic peptide
WLQQHQGHPPKLLSY

SEQ ID NO: 11148 - protein, 15 aa, Artificial Sequence
  Description of Artificial Sequence: Synthetic peptide
WYQQHPGKAPKLMIY

SEQ ID NO: 11149 - protein, 15 aa, Artificial Sequence
  Description of Artificial Sequence: Synthetic peptide
WYQQHPGKAPKLMIY

SEQ ID NO: 11150 - protein, 15 aa, Artificial Sequence
  Description of Artificial Sequence: Synthetic peptide
WLQQHQGHPPKLLSY

SEQ ID NO: 11151 - protein, 15 aa, Artificial Sequence
  Description of Artificial Sequence: Synthetic peptide
WLQQHQGHPPKLLSY

SEQ ID NO: 11152 - protein, 15 aa, Artificial Sequence
  Description of Artificial Sequence: Synthetic peptide
WYQQKPGQAPVLVIY

SEQ ID NO: 11153 - protein, 15 aa, Artificial Sequence
  Description of Artificial Sequence: Synthetic peptide
WYQQKPGQAPVLVVY

SEQ ID NO: 11154 - protein, 15 aa, Artificial Sequence
  Description of Artificial Sequence: Synthetic peptide
WYQQKPGQAPVLVVY

SEQ ID NO: 11155 - protein, 15 aa, Artificial Sequence
  Description of Artificial Sequence: Synthetic peptide
WYQQKPGQAPVMVVY

SEQ ID NO: 11156 - protein, 15 aa, Artificial Sequence
  Description of Artificial Sequence: Synthetic peptide
WHQQKPGQAPVMVVY

SEQ ID NO: 11157 - protein, 15 aa, Artificial Sequence
  Description of Artificial Sequence: Synthetic peptide
WYQQKPGQAPVLVVY

SEQ ID NO: 11158 - protein, 15 aa, Artificial Sequence
  Description of Artificial Sequence: Synthetic peptide
WYQQKPGQAPVLVVY

SEQ ID NO: 11159 - protein, 15 aa, Artificial Sequence
  Description of Artificial Sequence: Synthetic peptide
WYQQKPGQAPVLVVY

SEQ ID NO: 11160 - protein, 15 aa, Artificial Sequence
  Description of Artificial Sequence: Synthetic peptide
WYQQKPGQAPVMVVY

SEQ ID NO: 11161 - protein, 15 aa, Artificial Sequence
  Description of Artificial Sequence: Synthetic peptide
WYQQKPGQAPVLVVY

SEQ ID NO: 11162 - protein, 15 aa, Artificial Sequence
  Description of Artificial Sequence: Synthetic peptide
WYQQKPGQAPVLVVY

SEQ ID NO: 11163 - protein, 15 aa, Artificial Sequence
  Description of Artificial Sequence: Synthetic peptide
WYQQKPGQAPVMVVY

SEQ ID NO: 11164 - protein, 15 aa, Artificial Sequence
  Description of Artificial Sequence: Synthetic peptide
WYQQKPGQAPVLVVY

SEQ ID NO: 11165 - protein, 15 aa, Artificial Sequence
  Description of Artificial Sequence: Synthetic peptide
WYQQKPGQAPVMVVY

SEQ ID NO: 11166 - protein, 15 aa, Artificial Sequence
  Description of Artificial Sequence: Synthetic peptide
WYQQKPGQAPVMVVY

SEQ ID NO: 11167 - protein, 15 aa, Artificial Sequence
  Description of Artificial Sequence: Synthetic peptide
WYQQKPGQAPVLVVY

SEQ ID NO: 11168 - protein, 15 aa, Artificial Sequence
  Description of Artificial Sequence: Synthetic peptide
WYQQKPGQAPVLVVY

SEQ ID NO: 11169 - protein, 15 aa, Artificial Sequence
  Description of Artificial Sequence: Synthetic peptide
WYQQKPGQAPVMVVY

SEQ ID NO: 11170 - protein, 15 aa, Artificial Sequence
  Description of Artificial Sequence: Synthetic peptide
WYQQKPGQAPVLVVY

SEQ ID NO: 11171 - protein, 15 aa, Artificial Sequence
  Description of Artificial Sequence: Synthetic peptide
WYQQKPGQSPVMVVY

SEQ ID NO: 11172 - protein, 15 aa, Artificial Sequence
  Description of Artificial Sequence: Synthetic peptide
WYQQKPGQAPVMVVY

SEQ ID NO: 11173 - protein, 15 aa, Artificial Sequence
  Description of Artificial Sequence: Synthetic peptide
WYQQKPGQAPVLVVY

SEQ ID NO: 11174 - protein, 15 aa, Artificial Sequence
  Description of Artificial Sequence: Synthetic peptide
WYQQKPGQAPVMVVY

SEQ ID NO: 11175 - protein, 15 aa, Artificial Sequence
  Description of Artificial Sequence: Synthetic peptide
WYQQKPGQAPVLVVY

SEQ ID NO: 11176 - protein, 15 aa, Artificial Sequence
  Description of Artificial Sequence: Synthetic peptide
WYQQKPGQAPVLVVY

SEQ ID NO: 11177 - protein, 15 aa, Artificial Sequence
  Description of Artificial Sequence: Synthetic peptide
WYQQKPGQAPVMVVY

SEQ ID NO: 11178 - protein, 15 aa, Artificial Sequence
  Description of Artificial Sequence: Synthetic peptide
WYQQKPGQAPVLVVY

SEQ ID NO: 11179 - protein, 15 aa, Artificial Sequence
  Description of Artificial Sequence: Synthetic peptide
WYQQKPGQAPVLVVY

SEQ ID NO: 11180 - protein, 15 aa, Artificial Sequence
  Description of Artificial Sequence: Synthetic peptide
WYQQKPGQAPVMVVY

SEQ ID NO: 11181 - protein, 15 aa, Artificial Sequence
  Description of Artificial Sequence: Synthetic peptide
WHQQKPGQAPVLVVY

SEQ ID NO: 11182 - protein, 15 aa, Artificial Sequence
  Description of Artificial Sequence: Synthetic peptide
WYQQKPGQAPVLVVY

SEQ ID NO: 11183 - protein, 15 aa, Artificial Sequence
  Description of Artificial Sequence: Synthetic peptide
WYQQKPGQAPVMVVY

SEQ ID NO: 11184 - protein, 15 aa, Artificial Sequence
  Description of Artificial Sequence: Synthetic peptide
WYQQKPGQAPVLVVY

SEQ ID NO: 11185 - protein, 15 aa, Artificial Sequence
  Description of Artificial Sequence: Synthetic peptide
WYQQKPGQAPVLVVY

SEQ ID NO: 11186 - protein, 15 aa, Artificial Sequence
  Description of Artificial Sequence: Synthetic peptide
WHQQKPGQAPVLVVY

SEQ ID NO: 11187 - protein, 15 aa, Artificial Sequence
  Description of Artificial Sequence: Synthetic peptide
WYQQKPGQAPVLVVY

SEQ ID NO: 11188 - protein, 15 aa, Artificial Sequence
  Description of Artificial Sequence: Synthetic peptide
WYQQKPGQAPVLVVY

SEQ ID NO: 11189 - protein, 15 aa, Artificial Sequence
  Description of Artificial Sequence: Synthetic peptide
WHQQKPGQAPVLVVY

SEQ ID NO: 11190 - protein, 15 aa, Artificial Sequence
  Description of Artificial Sequence: Synthetic peptide
WYQQKPGQAPVLVVY

SEQ ID NO: 11191 - protein, 15 aa, Artificial Sequence
  Description of Artificial Sequence: Synthetic peptide
WHQQKPGQSPVLVIY

SEQ ID NO: 11192 - protein, 15 aa, Artificial Sequence
  Description of Artificial Sequence: Synthetic peptide
WYQQKPGQAPVMVVY

SEQ ID NO: 11193 - protein, 15 aa, Artificial Sequence
  Description of Artificial Sequence: Synthetic peptide
WYQQKPGQAPVLVVY

SEQ ID NO: 11194 - protein, 15 aa, Artificial Sequence
  Description of Artificial Sequence: Synthetic peptide
WYQQKPGQAPVMVVY

SEQ ID NO: 11195 - protein, 15 aa, Artificial Sequence
  Description of Artificial Sequence: Synthetic peptide
WHQQKPGQAPVLVVY

SEQ ID NO: 11196 - protein, 15 aa, Artificial Sequence
  Description of Artificial Sequence: Synthetic peptide
WHQQKPGQAPVLVVY

SEQ ID NO: 11197 - protein, 15 aa, Artificial Sequence
  Description of Artificial Sequence: Synthetic peptide
WHQQKPGQAPVLVVY

SEQ ID NO: 11198 - protein, 15 aa, Artificial Sequence
  Description of Artificial Sequence: Synthetic peptide
WYQQKPGQAPVLVVY

SEQ ID NO: 11199 - protein, 15 aa, Artificial Sequence
  Description of Artificial Sequence: Synthetic peptide
WYQQKPGQAPVMVVY

SEQ ID NO: 11200 - protein, 15 aa, Artificial Sequence
  Description of Artificial Sequence: Synthetic peptide
WYQQKPGQAPVMVVY

SEQ ID NO: 11201 - protein, 15 aa, Artificial Sequence
  Description of Artificial Sequence: Synthetic peptide
WYQQKPGQAPVMVVY

SEQ ID NO: 11202 - protein, 15 aa, Artificial Sequence
  Description of Artificial Sequence: Synthetic peptide
WYQQKPGQAPVLVVY

SEQ ID NO: 11203 - protein, 15 aa, Artificial Sequence
  Description of Artificial Sequence: Synthetic peptide
WYQQKPGQAPVMVVY

SEQ ID NO: 11204 - protein, 15 aa, Artificial Sequence
  Description of Artificial Sequence: Synthetic peptide
WYQQKPGQAPVMVVY

SEQ ID NO: 11205 - protein, 15 aa, Artificial Sequence
  Description of Artificial Sequence: Synthetic peptide
WYQQKPGQAPVMVVY

SEQ ID NO: 11206 - protein, 15 aa, Artificial Sequence
  Description of Artificial Sequence: Synthetic peptide
WYQQKPGQAPVMVVY

SEQ ID NO: 11207 - protein, 15 aa, Artificial Sequence
  Description of Artificial Sequence: Synthetic peptide
WYQQKPGQAPVMVVY

SEQ ID NO: 11208 - protein, 15 aa, Artificial Sequence
  Description of Artificial Sequence: Synthetic peptide
WYQQKPGQAPVMVVY

SEQ ID NO: 11209 - protein, 15 aa, Artificial Sequence
  Description of Artificial Sequence: Synthetic peptide
WYQQKPGQAPVMVVY

SEQ ID NO: 11210 - protein, 15 aa, Artificial Sequence
  Description of Artificial Sequence: Synthetic peptide
WYQQKPGQAPVMVVY

SEQ ID NO: 11211 - protein, 15 aa, Artificial Sequence
  Description of Artificial Sequence: Synthetic peptide
WYQQKPGQAPVLVIY

SEQ ID NO: 11212 - protein, 15 aa, Artificial Sequence
  Description of Artificial Sequence: Synthetic peptide
WYQQKPGQAPVMVVY

SEQ ID NO: 11213 - protein, 15 aa, Artificial Sequence
  Description of Artificial Sequence: Synthetic peptide
WYQQKPGQAPVMVVY

SEQ ID NO: 11214 - protein, 14 aa, Artificial Sequence
  Description of Artificial Sequence: Synthetic peptide
WVQQAPGKGLEWMG

SEQ ID NO: 11215 - protein, 14 aa, Artificial Sequence
  Description of Artificial Sequence: Synthetic peptide
WVKQRPGKGLEWIG

SEQ ID NO: 11216 - protein, 14 aa, Artificial Sequence
  Description of Artificial Sequence: Synthetic peptide
WVRQAPGQGLEWMG

SEQ ID NO: 11217 - protein, 14 aa, Artificial Sequence
  Description of Artificial Sequence: Synthetic peptide
WVKQRPGEGLEWIG

SEQ ID NO: 11218 - protein, 14 aa, Artificial Sequence
  Description of Artificial Sequence: Synthetic peptide
WVRQAPGQGLEWMG

SEQ ID NO: 11219 - protein, 14 aa, Artificial Sequence
  Description of Artificial Sequence: Synthetic peptide
WVKQRPGKGLEWIG

SEQ ID NO: 11220 - protein, 14 aa, Artificial Sequence
  Description of Artificial Sequence: Synthetic peptide
WVRQATGQGLEWMG

SEQ ID NO: 11221 - protein, 14 aa, Artificial Sequence
  Description of Artificial Sequence: Synthetic peptide
WVRQATGQGLEWMG

SEQ ID NO: 11222 - protein, 14 aa, Artificial Sequence
  Description of Artificial Sequence: Synthetic peptide
WVRQATGQGLEWMG

SEQ ID NO: 11223 - protein, 14 aa, Artificial Sequence
  Description of Artificial Sequence: Synthetic peptide
WVRQATGQGLEWMG

SEQ ID NO: 11224 - protein, 14 aa, Artificial Sequence
  Description of Artificial Sequence: Synthetic peptide
WVRQATGQGLEWMG

SEQ ID NO: 11225 - protein, 14 aa, Artificial Sequence
  Description of Artificial Sequence: Synthetic peptide
WVRQATGQGLEWMG

SEQ ID NO: 11226 - protein, 14 aa, Artificial Sequence
  Description of Artificial Sequence: Synthetic peptide
WVRQATGQGLEWMG

SEQ ID NO: 11227 - protein, 14 aa, Artificial Sequence
  Description of Artificial Sequence: Synthetic peptide
WIRQPPGKGLEWIG

SEQ ID NO: 11228 - protein, 14 aa, Artificial Sequence
  Description of Artificial Sequence: Synthetic peptide
WIRQPPGKGLEWIG

SEQ ID NO: 11229 - protein, 14 aa, Artificial Sequence
  Description of Artificial Sequence: Synthetic peptide
WIRQPPGKGLEWIG

SEQ ID NO: 11230 - protein, 14 aa, Artificial Sequence
  Description of Artificial Sequence: Synthetic peptide
WIRQPPGKGLEWIG

SEQ ID NO: 11231 - protein, 14 aa, Artificial Sequence
  Description of Artificial Sequence: Synthetic peptide
WIRQPPGKGLEWIG

SEQ ID NO: 11232 - protein, 14 aa, Artificial Sequence
  Description of Artificial Sequence: Synthetic peptide
WIRQPPGKGLEWIG

SEQ ID NO: 11233 - protein, 14 aa, Artificial Sequence
  Description of Artificial Sequence: Synthetic peptide
WIRQPPGKGLEWIG

SEQ ID NO: 11234 - protein, 14 aa, Artificial Sequence
  Description of Artificial Sequence: Synthetic peptide
WIRQPPGKGLEWIG

SEQ ID NO: 11235 - protein, 14 aa, Artificial Sequence
  Description of Artificial Sequence: Synthetic peptide
WIRQPPGKGLEWIG

SEQ ID NO: 11236 - protein, 14 aa, Artificial Sequence
  Description of Artificial Sequence: Synthetic peptide
WIRQPPGKGLEWIG

SEQ ID NO: 11237 - protein, 14 aa, Artificial Sequence
  Description of Artificial Sequence: Synthetic peptide
WIRQPPGKGLEWIG

SEQ ID NO: 11238 - protein, 14 aa, Artificial Sequence
  Description of Artificial Sequence: Synthetic peptide
WVRQAPGKGLEWVS

SEQ ID NO: 11239 - protein, 14 aa, Artificial Sequence
  Description of Artificial Sequence: Synthetic peptide
WVRQAPGKGLEWVS

SEQ ID NO: 11240 - protein, 14 aa, Artificial Sequence
  Description of Artificial Sequence: Synthetic peptide
WVRQAPGKGLEWVS

SEQ ID NO: 11241 - protein, 14 aa, Artificial Sequence
  Description of Artificial Sequence: Synthetic peptide
WVRQAPGKGLEWVS

SEQ ID NO: 11242 - protein, 14 aa, Artificial Sequence
  Description of Artificial Sequence: Synthetic peptide
WVRQAPGKGLEWVS

SEQ ID NO: 11243 - protein, 14 aa, Artificial Sequence
  Description of Artificial Sequence: Synthetic peptide
WVRQAPGKGLEWVS

SEQ ID NO: 11244 - protein, 14 aa, Artificial Sequence
  Description of Artificial Sequence: Synthetic peptide
WVRQAPGKGLEWVA

SEQ ID NO: 11245 - protein, 14 aa, Artificial Sequence
  Description of Artificial Sequence: Synthetic peptide
WVRQAPGKGLEWVA

SEQ ID NO: 11246 - protein, 14 aa, Artificial Sequence
  Description of Artificial Sequence: Synthetic peptide
WVRQAPGKGLEWVA

SEQ ID NO: 11247 - protein, 14 aa, Artificial Sequence
  Description of Artificial Sequence: Synthetic peptide
WIRQPPGKGLEWIG

SEQ ID NO: 11248 - protein, 14 aa, Artificial Sequence
  Description of Artificial Sequence: Synthetic peptide
WIRQPPGKGLEWIG

SEQ ID NO: 11249 - protein, 14 aa, Artificial Sequence
  Description of Artificial Sequence: Synthetic peptide
WIRQPPGKGLEWIG

SEQ ID NO: 11250 - protein, 14 aa, Artificial Sequence
  Description of Artificial Sequence: Synthetic peptide
WIRQPPGKGLEWIG

SEQ ID NO: 11251 - protein, 14 aa, Artificial Sequence
  Description of Artificial Sequence: Synthetic peptide
WIRQPPGKGLEWIG

SEQ ID NO: 11252 - protein, 14 aa, Artificial Sequence
  Description of Artificial Sequence: Synthetic peptide
WIRQPPGKGLEWIG

SEQ ID NO: 11253 - protein, 14 aa, Artificial Sequence
  Description of Artificial Sequence: Synthetic peptide
WIRQPPGKGLEWIG

SEQ ID NO: 11254 - protein, 14 aa, Artificial Sequence
  Description of Artificial Sequence: Synthetic peptide
WIRQPPGKGLEWIG

SEQ ID NO: 11255 - protein, 14 aa, Artificial Sequence
  Description of Artificial Sequence: Synthetic peptide
WIRQPPGKGLEWIG

SEQ ID NO: 11256 - protein, 14 aa, Artificial Sequence
  Description of Artificial Sequence: Synthetic peptide
WIRQPPGKGLEWIG

SEQ ID NO: 11257 - protein, 14 aa, Artificial Sequence
  Description of Artificial Sequence: Synthetic peptide
WVRQAPGKGLEWVS

SEQ ID NO: 11258 - protein, 14 aa, Artificial Sequence
  Description of Artificial Sequence: Synthetic peptide
WVRQAPGRGLEWVS

SEQ ID NO: 11259 - protein, 14 aa, Artificial Sequence
  Description of Artificial Sequence: Synthetic peptide
WVRQAPGRGLEWVS

SEQ ID NO: 11260 - protein, 14 aa, Artificial Sequence
  Description of Artificial Sequence: Synthetic peptide
WVRQAPGKGLEWVS

SEQ ID NO: 11261 - protein, 14 aa, Artificial Sequence
  Description of Artificial Sequence: Synthetic peptide
WVRQAPGRGLEWVS

SEQ ID NO: 11262 - protein, 14 aa, Artificial Sequence
  Description of Artificial Sequence: Synthetic peptide
WVRQAPGKGLEWVS

SEQ ID NO: 11263 - protein, 14 aa, Artificial Sequence
  Description of Artificial Sequence: Synthetic peptide
WVRQAPGKGLEWVS

SEQ ID NO: 11264 - protein, 14 aa, Artificial Sequence
  Description of Artificial Sequence: Synthetic peptide
WVRQAPGKGLEWVS

SEQ ID NO: 11265 - protein, 14 aa, Artificial Sequence
  Description of Artificial Sequence: Synthetic peptide
WVRQAPGKGLEWVS

SEQ ID NO: 11266 - protein, 14 aa, Artificial Sequence
  Description of Artificial Sequence: Synthetic peptide
WVRQAPGKGLEWVS

SEQ ID NO: 11267 - protein, 14 aa, Artificial Sequence
  Description of Artificial Sequence: Synthetic peptide
WVRQAPGKGLEWVS

SEQ ID NO: 11268 - protein, 14 aa, Artificial Sequence
  Description of Artificial Sequence: Synthetic peptide
WVRQAPGKGLEWVS

SEQ ID NO: 11269 - protein, 14 aa, Artificial Sequence
  Description of Artificial Sequence: Synthetic peptide
WVRQAPGKGLEWVS

SEQ ID NO: 11270 - protein, 14 aa, Artificial Sequence
  Description of Artificial Sequence: Synthetic peptide
WIRQHPGKGLEWIG

SEQ ID NO: 11271 - protein, 14 aa, Artificial Sequence
  Description of Artificial Sequence: Synthetic peptide
WIRQHPGKGLEWIG

SEQ ID NO: 11272 - protein, 14 aa, Artificial Sequence
  Description of Artificial Sequence: Synthetic peptide
WIRQHPGKGLEWIG

SEQ ID NO: 11273 - protein, 14 aa, Artificial Sequence
  Description of Artificial Sequence: Synthetic peptide
WIRQLPGKGLEWIG

SEQ ID NO: 11274 - protein, 14 aa, Artificial Sequence
  Description of Artificial Sequence: Synthetic peptide
WIRQHPGKGLEWIG

SEQ ID NO: 11275 - protein, 14 aa, Artificial Sequence
  Description of Artificial Sequence: Synthetic peptide
WIRQHPGKGLEWIG

SEQ ID NO: 11276 - protein, 14 aa, Artificial Sequence
  Description of Artificial Sequence: Synthetic peptide
WIRQHPGKGLEWIG

SEQ ID NO: 11277 - protein, 14 aa, Artificial Sequence
  Description of Artificial Sequence: Synthetic peptide
WIRQHPGKGLEWIG

SEQ ID NO: 11278 - protein, 14 aa, Artificial Sequence
  Description of Artificial Sequence: Synthetic peptide
WIRQHPGKGLEWIG

SEQ ID NO: 11279 - protein, 14 aa, Artificial Sequence
  Description of Artificial Sequence: Synthetic peptide
WIRQLPGKGLEWIG

SEQ ID NO: 11280 - protein, 14 aa, Artificial Sequence
  Description of Artificial Sequence: Synthetic peptide
WIRQHPGKGLEWIG

SEQ ID NO: 11281 - protein, 14 aa, Artificial Sequence
  Description of Artificial Sequence: Synthetic peptide
WIRQHPGKGLEWIG

SEQ ID NO: 11282 - protein, 14 aa, Artificial Sequence
  Description of Artificial Sequence: Synthetic peptide
WIRQHPGMGLEWIG

SEQ ID NO: 11283 - protein, 14 aa, Artificial Sequence
  Description of Artificial Sequence: Synthetic peptide
WIRQHPGKGLEWIG

SEQ ID NO: 11284 - protein, 14 aa, Artificial Sequence
  Description of Artificial Sequence: Synthetic peptide
WIRQHPGKGLEWIG

SEQ ID NO: 11285 - protein, 14 aa, Artificial Sequence
  Description of Artificial Sequence: Synthetic peptide
WIRQHPGKGLEWIG

SEQ ID NO: 11286 - protein, 14 aa, Artificial Sequence
  Description of Artificial Sequence: Synthetic peptide
WIRQLPGKGLEWIG

SEQ ID NO: 11287 - protein, 14 aa, Artificial Sequence
  Description of Artificial Sequence: Synthetic peptide
WIRQHPGKGLEWIG

SEQ ID NO: 11288 - protein, 14 aa, Artificial Sequence
  Description of Artificial Sequence: Synthetic peptide
WIRQLPGKGLEWIG

SEQ ID NO: 11289 - protein, 14 aa, Artificial Sequence
  Description of Artificial Sequence: Synthetic peptide
WVRQAPGKGLEWVS

SEQ ID NO: 11290 - protein, 14 aa, Artificial Sequence
  Description of Artificial Sequence: Synthetic peptide
WVRQAPGKGLEWVS

SEQ ID NO: 11291 - protein, 14 aa, Artificial Sequence
  Description of Artificial Sequence: Synthetic peptide
WVRQAPGKGLEWVA

SEQ ID NO: 11292 - protein, 14 aa, Artificial Sequence
  Description of Artificial Sequence: Synthetic peptide
WVRQAPGKGLEWVA

SEQ ID NO: 11293 - protein, 14 aa, Artificial Sequence
  Description of Artificial Sequence: Synthetic peptide
WVRQAPGKGLEWVA

SEQ ID NO: 11294 - protein, 14 aa, Artificial Sequence
  Description of Artificial Sequence: Synthetic peptide
WVRQATGQGLEWMG

SEQ ID NO: 11295 - protein, 14 aa, Artificial Sequence
  Description of Artificial Sequence: Synthetic peptide
WVRQATGQGLEWMG

SEQ ID NO: 11296 - protein, 14 aa, Artificial Sequence
  Description of Artificial Sequence: Synthetic peptide
WVRQATGQGLEWMG

SEQ ID NO: 11297 - protein, 14 aa, Artificial Sequence
  Description of Artificial Sequence: Synthetic peptide
WVRQATGQGLEWMG

SEQ ID NO: 11298 - protein, 14 aa, Artificial Sequence
  Description of Artificial Sequence: Synthetic peptide
WVRQATGQGLEWMG

SEQ ID NO: 11299 - protein, 14 aa, Artificial Sequence
  Description of Artificial Sequence: Synthetic peptide
WVRQATGQGLEWMG

SEQ ID NO: 11300 - protein, 14 aa, Artificial Sequence
  Description of Artificial Sequence: Synthetic peptide
WVRQAPGKGLEWVS

SEQ ID NO: 11301 - protein, 14 aa, Artificial Sequence
  Description of Artificial Sequence: Synthetic peptide
WVRQAPGKGLEWVS

SEQ ID NO: 11302 - protein, 14 aa, Artificial Sequence
  Description of Artificial Sequence: Synthetic peptide
WVRQAPGKGLEWVA

SEQ ID NO: 11303 - protein, 14 aa, Artificial Sequence
  Description of Artificial Sequence: Synthetic peptide
WVRQAPGKGLEWVA

SEQ ID NO: 11304 - protein, 14 aa, Artificial Sequence
  Description of Artificial Sequence: Synthetic peptide
WVRQAPGKGLEWVA

SEQ ID NO: 11305 - protein, 14 aa, Artificial Sequence
  Description of Artificial Sequence: Synthetic peptide
WIRQPPGKGLEWIG

SEQ ID NO: 11306 - protein, 14 aa, Artificial Sequence
  Description of Artificial Sequence: Synthetic peptide
WIRQPPGKGLEWIG

SEQ ID NO: 11307 - protein, 14 aa, Artificial Sequence
  Description of Artificial Sequence: Synthetic peptide
WIRQPPGKGLEWIG

SEQ ID NO: 11308 - protein, 14 aa, Artificial Sequence
  Description of Artificial Sequence: Synthetic peptide
WIRQPPGKGLEWIG

SEQ ID NO: 11309 - protein, 14 aa, Artificial Sequence
  Description of Artificial Sequence: Synthetic peptide
WIRQPPGKGLEWIG

SEQ ID NO: 11310 - protein, 14 aa, Artificial Sequence
  Description of Artificial Sequence: Synthetic peptide
WIRQSPSRGLEWLG

SEQ ID NO: 11311 - protein, 14 aa, Artificial Sequence
  Description of Artificial Sequence: Synthetic peptide
WIRQSPSRGLEWLG

SEQ ID NO: 11312 - protein, 14 aa, Artificial Sequence
  Description of Artificial Sequence: Synthetic peptide
WIRQPPGKGLEWIG

SEQ ID NO: 11313 - protein, 14 aa, Artificial Sequence
  Description of Artificial Sequence: Synthetic peptide
WIRQPPGKGLEWIG

SEQ ID NO: 11314 - protein, 14 aa, Artificial Sequence
  Description of Artificial Sequence: Synthetic peptide
WIRQPPGKALEWLA

SEQ ID NO: 11315 - protein, 14 aa, Artificial Sequence
  Description of Artificial Sequence: Synthetic peptide
WIRQPPGKALEWLA

SEQ ID NO: 11316 - protein, 14 aa, Artificial Sequence
  Description of Artificial Sequence: Synthetic peptide
WIRQPPGKALEWLA

SEQ ID NO: 11317 - protein, 14 aa, Artificial Sequence
  Description of Artificial Sequence: Synthetic peptide
WIRQPPGKALEWLA

SEQ ID NO: 11318 - protein, 14 aa, Artificial Sequence
  Description of Artificial Sequence: Synthetic peptide
WVRQAPGKGLEWVS

SEQ ID NO: 11319 - protein, 14 aa, Artificial Sequence
  Description of Artificial Sequence: Synthetic peptide
WVRQAPGKGLEWVS

SEQ ID NO: 11320 - protein, 14 aa, Artificial Sequence
  Description of Artificial Sequence: Synthetic peptide
WIRQPPGKGLEWIG

SEQ ID NO: 11321 - protein, 14 aa, Artificial Sequence
  Description of Artificial Sequence: Synthetic peptide
WIRQPPGKGLEWIG

SEQ ID NO: 11322 - protein, 14 aa, Artificial Sequence
  Description of Artificial Sequence: Synthetic peptide
WIRQPPGKALEWLA

SEQ ID NO: 11323 - protein, 14 aa, Artificial Sequence
  Description of Artificial Sequence: Synthetic peptide
WIRQPPGKALEWLA

SEQ ID NO: 11324 - protein, 14 aa, Artificial Sequence
  Description of Artificial Sequence: Synthetic peptide
WIRQPPGKALEWLA

SEQ ID NO: 11325 - protein, 14 aa, Artificial Sequence
  Description of Artificial Sequence: Synthetic peptide
WIRQPPGKALEWLA

SEQ ID NO: 11326 - protein, 14 aa, Artificial Sequence
  Description of Artificial Sequence: Synthetic peptide
WIRQPPGKALEWLA

SEQ ID NO: 11327 - protein, 14 aa, Artificial Sequence
  Description of Artificial Sequence: Synthetic peptide
WIRQPPGKALEWLA

SEQ ID NO: 11328 - protein, 14 aa, Artificial Sequence
  Description of Artificial Sequence: Synthetic peptide
WIRQPPGKALEWLA

SEQ ID NO: 11329 - protein, 14 aa, Artificial Sequence
  Description of Artificial Sequence: Synthetic peptide
WIRQPPGKALEWLA

SEQ ID NO: 11330 - protein, 14 aa, Artificial Sequence
  Description of Artificial Sequence: Synthetic peptide
WIRQPPGKALEWLA

SEQ ID NO: 11331 - protein, 14 aa, Artificial Sequence
  Description of Artificial Sequence: Synthetic peptide
WIRQPPGKALEWLA

SEQ ID NO: 11332 - protein, 14 aa, Artificial Sequence
  Description of Artificial Sequence: Synthetic peptide
WIRQPPGKALEWLA

SEQ ID NO: 11333 - protein, 14 aa, Artificial Sequence
  Description of Artificial Sequence: Synthetic peptide
WVRQAPGKGLEWVS

SEQ ID NO: 11334 - protein, 14 aa, Artificial Sequence
  Description of Artificial Sequence: Synthetic peptide
WVRQAPGKGLEWVS

SEQ ID NO: 11335 - protein, 14 aa, Artificial Sequence
  Description of Artificial Sequence: Synthetic peptide
WVRQAPGKGLEWVS

SEQ ID NO: 11336 - protein, 14 aa, Artificial Sequence
  Description of Artificial Sequence: Synthetic peptide
WIRQHPGKGLEWIG

SEQ ID NO: 11337 - protein, 14 aa, Artificial Sequence
  Description of Artificial Sequence: Synthetic peptide
WIRQHPGKGLEWIG

SEQ ID NO: 11338 - protein, 14 aa, Artificial Sequence
  Description of Artificial Sequence: Synthetic peptide
WIRQHPGKGLEWIG

SEQ ID NO: 11339 - protein, 14 aa, Artificial Sequence
  Description of Artificial Sequence: Synthetic peptide
WIRQHPGKGLEWIG

SEQ ID NO: 11340 - protein, 14 aa, Artificial Sequence
  Description of Artificial Sequence: Synthetic peptide
WIRQHPGKGLEWIG

SEQ ID NO: 11341 - protein, 14 aa, Artificial Sequence
  Description of Artificial Sequence: Synthetic peptide
WIRQHPGKGLEWIG

SEQ ID NO: 11342 - protein, 14 aa, Artificial Sequence
  Description of Artificial Sequence: Synthetic peptide
WIRQHPGKGLEWIG

SEQ ID NO: 11343 - protein, 14 aa, Artificial Sequence
  Description of Artificial Sequence: Synthetic peptide
WVRQAPGKGLEWVG

SEQ ID NO: 11344 - protein, 14 aa, Artificial Sequence
  Description of Artificial Sequence: Synthetic peptide
WVRQAPGKGLEWVG

SEQ ID NO: 11345 - protein, 14 aa, Artificial Sequence
  Description of Artificial Sequence: Synthetic peptide
WVRQAPGKGLEWVG

SEQ ID NO: 11346 - protein, 14 aa, Artificial Sequence
  Description of Artificial Sequence: Synthetic peptide
WVRQAPGKGLEWVG

SEQ ID NO: 11347 - protein, 14 aa, Artificial Sequence
  Description of Artificial Sequence: Synthetic peptide
WVRQAPGKGLEWVG

SEQ ID NO: 11348 - protein, 14 aa, Artificial Sequence
  Description of Artificial Sequence: Synthetic peptide
WVRQAPGKGLEWVG

SEQ ID NO: 11349 - protein, 14 aa, Artificial Sequence
  Description of Artificial Sequence: Synthetic peptide
WVRQAPGKGLEWVG

SEQ ID NO: 11350 - protein, 14 aa, Artificial Sequence
  Description of Artificial Sequence: Synthetic peptide
WVRQAPGKGLEWVG

SEQ ID NO: 11351 - protein, 14 aa, Artificial Sequence
  Description of Artificial Sequence: Synthetic peptide
WVRQAPGKGLEWVG

SEQ ID NO: 11352 - protein, 14 aa, Artificial Sequence
  Description of Artificial Sequence: Synthetic peptide
WVRQAPGKGLEWVG

SEQ ID NO: 11353 - protein, 14 aa, Artificial Sequence
  Description of Artificial Sequence: Synthetic peptide
WVRQAPGKGLEWVG

SEQ ID NO: 11354 - protein, 14 aa, Artificial Sequence
  Description of Artificial Sequence: Synthetic peptide
WVRQAPGKGLEWVG

SEQ ID NO: 11355 - protein, 14 aa, Artificial Sequence
  Description of Artificial Sequence: Synthetic peptide
WVRQAPGKGLEWVG

SEQ ID NO: 11356 - protein, 14 aa, Artificial Sequence
  Description of Artificial Sequence: Synthetic peptide
WVRQAPGKGLEWVG

SEQ ID NO: 11357 - protein, 14 aa, Artificial Sequence
  Description of Artificial Sequence: Synthetic peptide
WVRQAPGKGLEWVG

SEQ ID NO: 11358 - protein, 14 aa, Artificial Sequence
  Description of Artificial Sequence: Synthetic peptide
WVRQAPGKGLEWVG

SEQ ID NO: 11359 - protein, 14 aa, Artificial Sequence
  Description of Artificial Sequence: Synthetic peptide
WVRQAPGKGLEWVG

SEQ ID NO: 11360 - protein, 14 aa, Artificial Sequence
  Description of Artificial Sequence: Synthetic peptide
WVRQAPGKGLEWVG

SEQ ID NO: 11361 - protein, 14 aa, Artificial Sequence
  Description of Artificial Sequence: Synthetic peptide
WVRQAPGKGLEWVG

SEQ ID NO: 11362 - protein, 14 aa, Artificial Sequence
  Description of Artificial Sequence: Synthetic peptide
WVRQAPGKGLEWVG

SEQ ID NO: 11363 - protein, 14 aa, Artificial Sequence
  Description of Artificial Sequence: Synthetic peptide
WVRQAPGKGLEWVG

SEQ ID NO: 11364 - protein, 14 aa, Artificial Sequence
  Description of Artificial Sequence: Synthetic peptide
WVRQAPGKGLEWVG

SEQ ID NO: 11365 - protein, 14 aa, Artificial Sequence
  Description of Artificial Sequence: Synthetic peptide
WVRQAPGKGLEWVG

SEQ ID NO: 11366 - protein, 14 aa, Artificial Sequence
  Description of Artificial Sequence: Synthetic peptide
WVRQAPGKGLEWVG

SEQ ID NO: 11367 - protein, 14 aa, Artificial Sequence
  Description of Artificial Sequence: Synthetic peptide
WIRQPPGKGLEWIG

SEQ ID NO: 11368 - protein, 14 aa, Artificial Sequence
  Description of Artificial Sequence: Synthetic peptide
WIRQPAGKGLEWIG

SEQ ID NO: 11369 - protein, 14 aa, Artificial Sequence
  Description of Artificial Sequence: Synthetic peptide
WIRQPPGKGLEWIG

SEQ ID NO: 11370 - protein, 14 aa, Artificial Sequence
  Description of Artificial Sequence: Synthetic peptide
WVRQPAGKGLEWIG

SEQ ID NO: 11371 - protein, 14 aa, Artificial Sequence
  Description of Artificial Sequence: Synthetic peptide
WVRQAPGKGLEWVS

SEQ ID NO: 11372 - protein, 14 aa, Artificial Sequence
  Description of Artificial Sequence: Synthetic peptide
WVRQAPGKGLEWVS

SEQ ID NO: 11373 - protein, 14 aa, Artificial Sequence
  Description of Artificial Sequence: Synthetic peptide
WVRQAPGKGLEWVS

SEQ ID NO: 11374 - protein, 14 aa, Artificial Sequence
  Description of Artificial Sequence: Synthetic peptide
WVRQAPGKGLEWVS

SEQ ID NO: 11375 - protein, 14 aa, Artificial Sequence
  Description of Artificial Sequence: Synthetic peptide
WVRQAPGKGLEWVS

SEQ ID NO: 11376 - protein, 14 aa, Artificial Sequence
  Description of Artificial Sequence: Synthetic peptide
WVRQAPGKGLEWVS

SEQ ID NO: 11377 - protein, 14 aa, Artificial Sequence
  Description of Artificial Sequence: Synthetic peptide
WVRQAPGKGLEWVS

SEQ ID NO: 11378 - protein, 14 aa, Artificial Sequence
  Description of Artificial Sequence: Synthetic peptide
WVRQAPGKGLEWVS

SEQ ID NO: 11379 - protein, 14 aa, Artificial Sequence
  Description of Artificial Sequence: Synthetic peptide
WVRQAPGKGLEWVS

SEQ ID NO: 11380 - protein, 14 aa, Artificial Sequence
  Description of Artificial Sequence: Synthetic peptide
WVRQAPGKGLEWVS

SEQ ID NO: 11381 - protein, 14 aa, Artificial Sequence
  Description of Artificial Sequence: Synthetic peptide
WVRQAPGKGLEWVS

SEQ ID NO: 11382 - protein, 14 aa, Artificial Sequence
  Description of Artificial Sequence: Synthetic peptide
WVRQAPGKGLEWVS

SEQ ID NO: 11383 - protein, 14 aa, Artificial Sequence
  Description of Artificial Sequence: Synthetic peptide
WVRQAPGKGLEWVS

SEQ ID NO: 11384 - protein, 14 aa, Artificial Sequence
  Description of Artificial Sequence: Synthetic peptide
WVRQAPGKGLEWVS

SEQ ID NO: 11385 - protein, 14 aa, Artificial Sequence
  Description of Artificial Sequence: Synthetic peptide
WVRQAPGKGLEWVS

SEQ ID NO: 11386 - protein, 14 aa, Artificial Sequence
  Description of Artificial Sequence: Synthetic peptide
WVRQAPGKGLEWVS

SEQ ID NO: 11387 - protein, 14 aa, Artificial Sequence
  Description of Artificial Sequence: Synthetic peptide
WVRQAPGKGLEWVS

SEQ ID NO: 11388 - protein, 14 aa, Artificial Sequence
  Description of Artificial Sequence: Synthetic peptide
WVRQAPGKGLEWVS

SEQ ID NO: 11389 - protein, 14 aa, Artificial Sequence
  Description of Artificial Sequence: Synthetic peptide
WVRQAPGKGLEWVS

SEQ ID NO: 11390 - protein, 14 aa, Artificial Sequence
  Description of Artificial Sequence: Synthetic peptide
WVRQAPGKGLEWVS

SEQ ID NO: 11391 - protein, 14 aa, Artificial Sequence
  Description of Artificial Sequence: Synthetic peptide
WVRQAPGKGLEWVS

SEQ ID NO: 11392 - protein, 14 aa, Artificial Sequence
  Description of Artificial Sequence: Synthetic peptide
WVRQAPGKGLEWVS

SEQ ID NO: 11393 - protein, 14 aa, Artificial Sequence
  Description of Artificial Sequence: Synthetic peptide
WVRQAPGKGLEWVS

SEQ ID NO: 11394 - protein, 14 aa, Artificial Sequence
  Description of Artificial Sequence: Synthetic peptide
WVRQAPGKGLEWVS

SEQ ID NO: 11395 - protein, 14 aa, Artificial Sequence
  Description of Artificial Sequence: Synthetic peptide
WVRQAPGKGLEWVS

SEQ ID NO: 11396 - protein, 14 aa, Artificial Sequence
  Description of Artificial Sequence: Synthetic peptide
WVRQAPGKGLEWVS

SEQ ID NO: 11397 - protein, 14 aa, Artificial Sequence
  Description of Artificial Sequence: Synthetic peptide
WVRQAPGKGLEWVS

SEQ ID NO: 11398 - protein, 14 aa, Artificial Sequence
  Description of Artificial Sequence: Synthetic peptide
WVRQAPGKGLEWVS

SEQ ID NO: 11399 - protein, 14 aa, Artificial Sequence
  Description of Artificial Sequence: Synthetic peptide
WVRQAPGQGLEWVS

SEQ ID NO: 11400 - protein, 14 aa, Artificial Sequence
  Description of Artificial Sequence: Synthetic peptide
WVRQAPGKGLEWVS

SEQ ID NO: 11401 - protein, 14 aa, Artificial Sequence
  Description of Artificial Sequence: Synthetic peptide
WVRQAPGKGLEWVS

SEQ ID NO: 11402 - protein, 14 aa, Artificial Sequence
  Description of Artificial Sequence: Synthetic peptide
WVRQAPGKGLEWVS

SEQ ID NO: 11403 - protein, 14 aa, Artificial Sequence
  Description of Artificial Sequence: Synthetic peptide
WVRQAPGKGLEWVS

SEQ ID NO: 11404 - protein, 14 aa, Artificial Sequence
  Description of Artificial Sequence: Synthetic peptide
WVRQAPGKGLEWVS

SEQ ID NO: 11405 - protein, 14 aa, Artificial Sequence
  Description of Artificial Sequence: Synthetic peptide
WVRQAPGKGLEWVS

SEQ ID NO: 11406 - protein, 14 aa, Artificial Sequence
  Description of Artificial Sequence: Synthetic peptide
WVRQAPGKGLEWVS

SEQ ID NO: 11407 - protein, 14 aa, Artificial Sequence
  Description of Artificial Sequence: Synthetic peptide
WVRQAPGKGLEWVS

SEQ ID NO: 11408 - protein, 14 aa, Artificial Sequence
  Description of Artificial Sequence: Synthetic peptide
WVRQAPGKGLEWVS

SEQ ID NO: 11409 - protein, 14 aa, Artificial Sequence
  Description of Artificial Sequence: Synthetic peptide
WVRQAPGKGLEWVS

SEQ ID NO: 11410 - protein, 14 aa, Artificial Sequence
  Description of Artificial Sequence: Synthetic peptide
WVRQAPGKGLEWVS

SEQ ID NO: 11411 - protein, 14 aa, Artificial Sequence
  Description of Artificial Sequence: Synthetic peptide
WVRQAPGKGLEWVS

SEQ ID NO: 11412 - protein, 14 aa, Artificial Sequence
  Description of Artificial Sequence: Synthetic peptide
WVRQAPGQGLEWVS

SEQ ID NO: 11413 - protein, 14 aa, Artificial Sequence
  Description of Artificial Sequence: Synthetic peptide
WVRQAPGKGLEWVS

SEQ ID NO: 11414 - protein, 14 aa, Artificial Sequence
  Description of Artificial Sequence: Synthetic peptide
WVRQAPGKGLEWVS

SEQ ID NO: 11415 - protein, 14 aa, Artificial Sequence
  Description of Artificial Sequence: Synthetic peptide
WVRQAPGQGLEWVS

SEQ ID NO: 11416 - protein, 14 aa, Artificial Sequence
  Description of Artificial Sequence: Synthetic peptide
WVRQAPGKGLEWVS

SEQ ID NO: 11417 - protein, 14 aa, Artificial Sequence
  Description of Artificial Sequence: Synthetic peptide
WVRQAPGKGLEWVS

SEQ ID NO: 11418 - protein, 14 aa, Artificial Sequence
  Description of Artificial Sequence: Synthetic peptide
WVRQAPGKGLEWVS

SEQ ID NO: 11419 - protein, 14 aa, Artificial Sequence
  Description of Artificial Sequence: Synthetic peptide
WVRQAPGKGLEWVS

SEQ ID NO: 11420 - protein, 14 aa, Artificial Sequence
  Description of Artificial Sequence: Synthetic peptide
WVRQAPGKGLEWVS

SEQ ID NO: 11421 - protein, 14 aa, Artificial Sequence
  Description of Artificial Sequence: Synthetic peptide
WVRQAPGKGLEWVS

SEQ ID NO: 11422 - protein, 14 aa, Artificial Sequence
  Description of Artificial Sequence: Synthetic peptide
WVRQAPGKGLEWVS

SEQ ID NO: 11423 - protein, 14 aa, Artificial Sequence
  Description of Artificial Sequence: Synthetic peptide
WVRQAPGKGLEWVS

SEQ ID NO: 11424 - protein, 14 aa, Artificial Sequence
  Description of Artificial Sequence: Synthetic peptide
WVRQAPGKGLEWVS

SEQ ID NO: 11425 - protein, 14 aa, Artificial Sequence
  Description of Artificial Sequence: Synthetic peptide
WVRQAPGKGLEWVS

SEQ ID NO: 11426 - protein, 14 aa, Artificial Sequence
  Description of Artificial Sequence: Synthetic peptide
WVRQAPGKGLEWVS

SEQ ID NO: 11427 - protein, 14 aa, Artificial Sequence
  Description of Artificial Sequence: Synthetic peptide
WVRQAPGKGLEWVS

SEQ ID NO: 11428 - protein, 14 aa, Artificial Sequence
  Description of Artificial Sequence: Synthetic peptide
WVRQAPGKGLEWVS

SEQ ID NO: 11429 - protein, 14 aa, Artificial Sequence
  Description of Artificial Sequence: Synthetic peptide
WVRQAPGKGLEWVS

SEQ ID NO: 11430 - protein, 14 aa, Artificial Sequence
  Description of Artificial Sequence: Synthetic peptide
WVRQAPGQGLEWVS

SEQ ID NO: 11431 - protein, 14 aa, Artificial Sequence
  Description of Artificial Sequence: Synthetic peptide
WVRQAPGKGLEWVA

SEQ ID NO: 11432 - protein, 14 aa, Artificial Sequence
  Description of Artificial Sequence: Synthetic peptide
WVRQAPGKGLEWVA

SEQ ID NO: 11433 - protein, 14 aa, Artificial Sequence
  Description of Artificial Sequence: Synthetic peptide
WVRQAPGKGLEWVA

SEQ ID NO: 11434 - protein, 14 aa, Artificial Sequence
  Description of Artificial Sequence: Synthetic peptide
WVRQAPGKGLEWVA

SEQ ID NO: 11435 - protein, 14 aa, Artificial Sequence
  Description of Artificial Sequence: Synthetic peptide
WVRQAPGQGLEWMG

SEQ ID NO: 11436 - protein, 14 aa, Artificial Sequence
  Description of Artificial Sequence: Synthetic peptide
WVRQAPGQGLEWMG

SEQ ID NO: 11437 - protein, 14 aa, Artificial Sequence
  Description of Artificial Sequence: Synthetic peptide
WVRQAPGQGLEWMG

SEQ ID NO: 11438 - protein, 14 aa, Artificial Sequence
  Description of Artificial Sequence: Synthetic peptide
WIRQAPGKGLEWVS

SEQ ID NO: 11439 - protein, 14 aa, Artificial Sequence
  Description of Artificial Sequence: Synthetic peptide
WIRQAPGKGLEWVS

SEQ ID NO: 11440 - protein, 14 aa, Artificial Sequence
  Description of Artificial Sequence: Synthetic peptide
WIRQAPGKGLEWVS

SEQ ID NO: 11441 - protein, 7 aa, Artificial Sequence
  Description of Artificial Sequence: Synthetic peptide
WASTRES

SEQ ID NO: 11442 - protein, 7 aa, Artificial Sequence
  Description of Artificial Sequence: Synthetic peptide
WASTRES

SEQ ID NO: 11443 - protein, 7 aa, Artificial Sequence
  Description of Artificial Sequence: Synthetic peptide
WASTRES

SEQ ID NO: 11444 - protein, 7 aa, Artificial Sequence
  Description of Artificial Sequence: Synthetic peptide
WASTRES

SEQ ID NO: 11445 - protein, 7 aa, Artificial Sequence
  Description of Artificial Sequence: Synthetic peptide
YASQSFS

SEQ ID NO: 11446 - protein, 7 aa, Artificial Sequence
  Description of Artificial Sequence: Synthetic peptide
DTSKLAP

SEQ ID NO: 11447 - protein, 7 aa, Artificial Sequence
  Description of Artificial Sequence: Synthetic peptide
AASSLQS

SEQ ID NO: 11448 - protein, 7 aa, Artificial Sequence
  Description of Artificial Sequence: Synthetic peptide
NAKTLAG

SEQ ID NO: 11449 - protein, 7 aa, Artificial Sequence
  Description of Artificial Sequence: Synthetic peptide
LGSNRAS

SEQ ID NO: 11450 - protein, 7 aa, Artificial Sequence
  Description of Artificial Sequence: Synthetic peptide
LGSNRAS

SEQ ID NO: 11451 - protein, 7 aa, Artificial Sequence
  Description of Artificial Sequence: Synthetic peptide
LGSNRAS

SEQ ID NO: 11452 - protein, 7 aa, Artificial Sequence
  Description of Artificial Sequence: Synthetic peptide
LGSNRAS

SEQ ID NO: 11453 - protein, 7 aa, Artificial Sequence
  Description of Artificial Sequence: Synthetic peptide
LGSIRAS

SEQ ID NO: 11454 - protein, 7 aa, Artificial Sequence
  Description of Artificial Sequence: Synthetic peptide
LGSNRAS

SEQ ID NO: 11455 - protein, 7 aa, Artificial Sequence
  Description of Artificial Sequence: Synthetic peptide
LGSNRAS

SEQ ID NO: 11456 - protein, 7 aa, Artificial Sequence
  Description of Artificial Sequence: Synthetic peptide
LGSKRAS

SEQ ID NO: 11457 - protein, 7 aa, Artificial Sequence
  Description of Artificial Sequence: Synthetic peptide
LGSNRAS

SEQ ID NO: 11458 - protein, 7 aa, Artificial Sequence
  Description of Artificial Sequence: Synthetic peptide
LGSNRAS

SEQ ID NO: 11459 - protein, 7 aa, Artificial Sequence
  Description of Artificial Sequence: Synthetic peptide
LGSNRAS

SEQ ID NO: 11460 - protein, 7 aa, Artificial Sequence
  Description of Artificial Sequence: Synthetic peptide
LGSNRAS

SEQ ID NO: 11461 - protein, 7 aa, Artificial Sequence
  Description of Artificial Sequence: Synthetic peptide
TLSYRAS

SEQ ID NO: 11462 - protein, 7 aa, Artificial Sequence
  Description of Artificial Sequence: Synthetic peptide
LGSKRAS

SEQ ID NO: 11463 - protein, 7 aa, Artificial Sequence
  Description of Artificial Sequence: Synthetic peptide
LGSNRAS

SEQ ID NO: 11464 - protein, 7 aa, Artificial Sequence
  Description of Artificial Sequence: Synthetic peptide
LGSNRAS

SEQ ID NO: 11465 - protein, 7 aa, Artificial Sequence
  Description of Artificial Sequence: Synthetic peptide
LGSNRAS

SEQ ID NO: 11466 - protein, 7 aa, Artificial Sequence
  Description of Artificial Sequence: Synthetic peptide
LGSNRAS

SEQ ID NO: 11467 - protein, 7 aa, Artificial Sequence
  Description of Artificial Sequence: Synthetic peptide
LGSNRAS

SEQ ID NO: 11468 - protein, 7 aa, Artificial Sequence
  Description of Artificial Sequence: Synthetic peptide
LGSNRAS

SEQ ID NO: 11469 - protein, 7 aa, Artificial Sequence
  Description of Artificial Sequence: Synthetic peptide
GASSRAT

SEQ ID NO: 11470 - protein, 7 aa, Artificial Sequence
  Description of Artificial Sequence: Synthetic peptide
GASSRAT

SEQ ID NO: 11471 - protein, 7 aa, Artificial Sequence
  Description of Artificial Sequence: Synthetic peptide
GASSRAT

SEQ ID NO: 11472 - protein, 7 aa, Artificial Sequence
  Description of Artificial Sequence: Synthetic peptide
GASSRAT

SEQ ID NO: 11473 - protein, 7 aa, Artificial Sequence
  Description of Artificial Sequence: Synthetic peptide
GASSRAT

SEQ ID NO: 11474 - protein, 7 aa, Artificial Sequence
  Description of Artificial Sequence: Synthetic peptide
GASSRAT

SEQ ID NO: 11475 - protein, 7 aa, Artificial Sequence
  Description of Artificial Sequence: Synthetic peptide
GASARAT

SEQ ID NO: 11476 - protein, 7 aa, Artificial Sequence
  Description of Artificial Sequence: Synthetic peptide
GASSRAT

SEQ ID NO: 11477 - protein, 7 aa, Artificial Sequence
  Description of Artificial Sequence: Synthetic peptide
GASTRAT

SEQ ID NO: 11478 - protein, 7 aa, Artificial Sequence
  Description of Artificial Sequence: Synthetic peptide
LGSNRAS

SEQ ID NO: 11479 - protein, 7 aa, Artificial Sequence
  Description of Artificial Sequence: Synthetic peptide
LGSNRAS

SEQ ID NO: 11480 - protein, 7 aa, Artificial Sequence
  Description of Artificial Sequence: Synthetic peptide
LGSNRAS

SEQ ID NO: 11481 - protein, 7 aa, Artificial Sequence
  Description of Artificial Sequence: Synthetic peptide
LGSNRAS

SEQ ID NO: 11482 - protein, 7 aa, Artificial Sequence
  Description of Artificial Sequence: Synthetic peptide
LGSNRAS

SEQ ID NO: 11483 - protein, 7 aa, Artificial Sequence
  Description of Artificial Sequence: Synthetic peptide
LGSNRAS

SEQ ID NO: 11484 - protein, 7 aa, Artificial Sequence
  Description of Artificial Sequence: Synthetic peptide
LGSNRAS

SEQ ID NO: 11485 - protein, 7 aa, Artificial Sequence
  Description of Artificial Sequence: Synthetic peptide
LGSNRAS

SEQ ID NO: 11486 - protein, 7 aa, Artificial Sequence
  Description of Artificial Sequence: Synthetic peptide
LGSNRAS

SEQ ID NO: 11487 - protein, 7 aa, Artificial Sequence
  Description of Artificial Sequence: Synthetic peptide
LGSNRAS

SEQ ID NO: 11488 - protein, 7 aa, Artificial Sequence
  Description of Artificial Sequence: Synthetic peptide
LGSNRAS

SEQ ID NO: 11489 - protein, 7 aa, Artificial Sequence
  Description of Artificial Sequence: Synthetic peptide
LGSNRAS

SEQ ID NO: 11490 - protein, 7 aa, Artificial Sequence
  Description of Artificial Sequence: Synthetic peptide
AASSLQS

SEQ ID NO: 11491 - protein, 7 aa, Artificial Sequence
  Description of Artificial Sequence: Synthetic peptide
AASSLQS

SEQ ID NO: 11492 - protein, 7 aa, Artificial Sequence
  Description of Artificial Sequence: Synthetic peptide
AASSLQS

SEQ ID NO: 11493 - protein, 7 aa, Artificial Sequence
  Description of Artificial Sequence: Synthetic peptide
LGSNRAS

SEQ ID NO: 11494 - protein, 7 aa, Artificial Sequence
  Description of Artificial Sequence: Synthetic peptide
LGSNRAS

SEQ ID NO: 11495 - protein, 7 aa, Artificial Sequence
  Description of Artificial Sequence: Synthetic peptide
LGSNRAS

SEQ ID NO: 11496 - protein, 7 aa, Artificial Sequence
  Description of Artificial Sequence: Synthetic peptide
LGSYRAS

SEQ ID NO: 11497 - protein, 7 aa, Artificial Sequence
  Description of Artificial Sequence: Synthetic peptide
LGSNRAS

SEQ ID NO: 11498 - protein, 7 aa, Artificial Sequence
  Description of Artificial Sequence: Synthetic peptide
LGSNRAS

SEQ ID NO: 11499 - protein, 7 aa, Artificial Sequence
  Description of Artificial Sequence: Synthetic peptide
TLSYRAS

SEQ ID NO: 11500 - protein, 7 aa, Artificial Sequence
  Description of Artificial Sequence: Synthetic peptide
LGSNRAS

SEQ ID NO: 11501 - protein, 7 aa, Artificial Sequence
  Description of Artificial Sequence: Synthetic peptide
LGSNRAS

SEQ ID NO: 11502 - protein, 7 aa, Artificial Sequence
  Description of Artificial Sequence: Synthetic peptide
AASSLQS

SEQ ID NO: 11503 - protein, 7 aa, Artificial Sequence
  Description of Artificial Sequence: Synthetic peptide
DASSLQS

SEQ ID NO: 11504 - protein, 7 aa, Artificial Sequence
  Description of Artificial Sequence: Synthetic peptide
ATSSLQS

SEQ ID NO: 11505 - protein, 7 aa, Artificial Sequence
  Description of Artificial Sequence: Synthetic peptide
AASSLQS

SEQ ID NO: 11506 - protein, 7 aa, Artificial Sequence
  Description of Artificial Sequence: Synthetic peptide
AASSLQS

SEQ ID NO: 11507 - protein, 7 aa, Artificial Sequence
  Description of Artificial Sequence: Synthetic peptide
AASSLQS

SEQ ID NO: 11508 - protein, 7 aa, Artificial Sequence
  Description of Artificial Sequence: Synthetic peptide
AASSLQS

SEQ ID NO: 11509 - protein, 7 aa, Artificial Sequence
  Description of Artificial Sequence: Synthetic peptide
AASSLQS

SEQ ID NO: 11510 - protein, 7 aa, Artificial Sequence
  Description of Artificial Sequence: Synthetic peptide
TLSYRAS

SEQ ID NO: 11511 - protein, 7 aa, Artificial Sequence
  Description of Artificial Sequence: Synthetic peptide
LGSNRAS

SEQ ID NO: 11512 - protein, 7 aa, Artificial Sequence
  Description of Artificial Sequence: Synthetic peptide
LGSNRAS

SEQ ID NO: 11513 - protein, 7 aa, Artificial Sequence
  Description of Artificial Sequence: Synthetic peptide
LGSNRAS

SEQ ID NO: 11514 - protein, 7 aa, Artificial Sequence
  Description of Artificial Sequence: Synthetic peptide
LGSNRAS

SEQ ID NO: 11515 - protein, 7 aa, Artificial Sequence
  Description of Artificial Sequence: Synthetic peptide
LGSNRAS

SEQ ID NO: 11516 - protein, 7 aa, Artificial Sequence
  Description of Artificial Sequence: Synthetic peptide
LGSNRAS

SEQ ID NO: 11517 - protein, 7 aa, Artificial Sequence
  Description of Artificial Sequence: Synthetic peptide
LGSNRAS

SEQ ID NO: 11518 - protein, 7 aa, Artificial Sequence
  Description of Artificial Sequence: Synthetic peptide
LGSNRAS

SEQ ID NO: 11519 - protein, 7 aa, Artificial Sequence
  Description of Artificial Sequence: Synthetic peptide
LGSNRAS

SEQ ID NO: 11520 - protein, 7 aa, Artificial Sequence
  Description of Artificial Sequence: Synthetic peptide
LGSNRAS

SEQ ID NO: 11521 - protein, 7 aa, Artificial Sequence
  Description of Artificial Sequence: Synthetic peptide
LGSNRAS

SEQ ID NO: 11522 - protein, 7 aa, Artificial Sequence
  Description of Artificial Sequence: Synthetic peptide
LGSNRAS

SEQ ID NO: 11523 - protein, 7 aa, Artificial Sequence
  Description of Artificial Sequence: Synthetic peptide
TLSYRAS

SEQ ID NO: 11524 - protein, 7 aa, Artificial Sequence
  Description of Artificial Sequence: Synthetic peptide
LVSKRAS

SEQ ID NO: 11525 - protein, 7 aa, Artificial Sequence
  Description of Artificial Sequence: Synthetic peptide
LGSNRAS

SEQ ID NO: 11526 - protein, 7 aa, Artificial Sequence
  Description of Artificial Sequence: Synthetic peptide
LGSKRAS

SEQ ID NO: 11527 - protein, 7 aa, Artificial Sequence
  Description of Artificial Sequence: Synthetic peptide
AASTLQS

SEQ ID NO: 11528 - protein, 7 aa, Artificial Sequence
  Description of Artificial Sequence: Synthetic peptide
AASSLQS

SEQ ID NO: 11529 - protein, 7 aa, Artificial Sequence
  Description of Artificial Sequence: Synthetic peptide
GASTLQL

SEQ ID NO: 11530 - protein, 7 aa, Artificial Sequence
  Description of Artificial Sequence: Synthetic peptide
AASTLQS

SEQ ID NO: 11531 - protein, 7 aa, Artificial Sequence
  Description of Artificial Sequence: Synthetic peptide
AASTLQS

SEQ ID NO: 11532 - protein, 7 aa, Artificial Sequence
  Description of Artificial Sequence: Synthetic peptide
AASTLQS

SEQ ID NO: 11533 - protein, 7 aa, Artificial Sequence
  Description of Artificial Sequence: Synthetic peptide
AASTLQS

SEQ ID NO: 11534 - protein, 7 aa, Artificial Sequence
  Description of Artificial Sequence: Synthetic peptide
TLSYRAS

SEQ ID NO: 11535 - protein, 7 aa, Artificial Sequence
  Description of Artificial Sequence: Synthetic peptide
LGSNRAS

SEQ ID NO: 11536 - protein, 7 aa, Artificial Sequence
  Description of Artificial Sequence: Synthetic peptide
AASTLQS

SEQ ID NO: 11537 - protein, 7 aa, Artificial Sequence
  Description of Artificial Sequence: Synthetic peptide
AASTLQS

SEQ ID NO: 11538 - protein, 7 aa, Artificial Sequence
  Description of Artificial Sequence: Synthetic peptide
EVSSRFS

SEQ ID NO: 11539 - protein, 7 aa, Artificial Sequence
  Description of Artificial Sequence: Synthetic peptide
LGSNRAS

SEQ ID NO: 11540 - protein, 7 aa, Artificial Sequence
  Description of Artificial Sequence: Synthetic peptide
WASTRES

SEQ ID NO: 11541 - protein, 7 aa, Artificial Sequence
  Description of Artificial Sequence: Synthetic peptide
WASTRES

SEQ ID NO: 11542 - protein, 7 aa, Artificial Sequence
  Description of Artificial Sequence: Synthetic peptide
WASTRES

SEQ ID NO: 11543 - protein, 7 aa, Artificial Sequence
  Description of Artificial Sequence: Synthetic peptide
WASTRES

SEQ ID NO: 11544 - protein, 7 aa, Artificial Sequence
  Description of Artificial Sequence: Synthetic peptide
DASNLET

SEQ ID NO: 11545 - protein, 7 aa, Artificial Sequence
  Description of Artificial Sequence: Synthetic peptide
DASNLET

SEQ ID NO: 11546 - protein, 7 aa, Artificial Sequence
  Description of Artificial Sequence: Synthetic peptide
WASTRES

SEQ ID NO: 11547 - protein, 7 aa, Artificial Sequence
  Description of Artificial Sequence: Synthetic peptide
WASTRES

SEQ ID NO: 11548 - protein, 7 aa, Artificial Sequence
  Description of Artificial Sequence: Synthetic peptide
WASTRES

SEQ ID NO: 11549 - protein, 7 aa, Artificial Sequence
  Description of Artificial Sequence: Synthetic peptide
WASTRES

SEQ ID NO: 11550 - protein, 7 aa, Artificial Sequence
  Description of Artificial Sequence: Synthetic peptide
WASTRES

SEQ ID NO: 11551 - protein, 7 aa, Artificial Sequence
  Description of Artificial Sequence: Synthetic peptide
AASSLQS

SEQ ID NO: 11552 - protein, 7 aa, Artificial Sequence
  Description of Artificial Sequence: Synthetic peptide
AASSLQS

SEQ ID NO: 11553 - protein, 7 aa, Artificial Sequence
  Description of Artificial Sequence: Synthetic peptide
AASSLQS

SEQ ID NO: 11554 - protein, 7 aa, Artificial Sequence
  Description of Artificial Sequence: Synthetic peptide
AASSLQG

SEQ ID NO: 11555 - protein, 7 aa, Artificial Sequence
  Description of Artificial Sequence: Synthetic peptide
AASSLQS

SEQ ID NO: 11556 - protein, 7 aa, Artificial Sequence
  Description of Artificial Sequence: Synthetic peptide
AASSLQS

SEQ ID NO: 11557 - protein, 7 aa, Artificial Sequence
  Description of Artificial Sequence: Synthetic peptide
AASSLQG

SEQ ID NO: 11558 - protein, 7 aa, Artificial Sequence
  Description of Artificial Sequence: Synthetic peptide
AASSLQG

SEQ ID NO: 11559 - protein, 7 aa, Artificial Sequence
  Description of Artificial Sequence: Synthetic peptide
AASSLQG

SEQ ID NO: 11560 - protein, 7 aa, Artificial Sequence
  Description of Artificial Sequence: Synthetic peptide
AASSLQG

SEQ ID NO: 11561 - protein, 7 aa, Artificial Sequence
  Description of Artificial Sequence: Synthetic peptide
AASSLQS

SEQ ID NO: 11562 - protein, 7 aa, Artificial Sequence
  Description of Artificial Sequence: Synthetic peptide
AASSLQS

SEQ ID NO: 11563 - protein, 7 aa, Artificial Sequence
  Description of Artificial Sequence: Synthetic peptide
AASSLQS

SEQ ID NO: 11564 - protein, 7 aa, Artificial Sequence
  Description of Artificial Sequence: Synthetic peptide
AASSLQS

SEQ ID NO: 11565 - protein, 7 aa, Artificial Sequence
  Description of Artificial Sequence: Synthetic peptide
AASSLQG

SEQ ID NO: 11566 - protein, 7 aa, Artificial Sequence
  Description of Artificial Sequence: Synthetic peptide
AASSLQS

SEQ ID NO: 11567 - protein, 7 aa, Artificial Sequence
  Description of Artificial Sequence: Synthetic peptide
ATSSLQS

SEQ ID NO: 11568 - protein, 7 aa, Artificial Sequence
  Description of Artificial Sequence: Synthetic peptide
AASSLQG

SEQ ID NO: 11569 - protein, 7 aa, Artificial Sequence
  Description of Artificial Sequence: Synthetic peptide
AASSLQS

SEQ ID NO: 11570 - protein, 7 aa, Artificial Sequence
  Description of Artificial Sequence: Synthetic peptide
AASSLQG

SEQ ID NO: 11571 - protein, 7 aa, Artificial Sequence
  Description of Artificial Sequence: Synthetic peptide
AASSLQS

SEQ ID NO: 11572 - protein, 7 aa, Artificial Sequence
  Description of Artificial Sequence: Synthetic peptide
AASSLQG

SEQ ID NO: 11573 - protein, 7 aa, Artificial Sequence
  Description of Artificial Sequence: Synthetic peptide
AASSLQS

SEQ ID NO: 11574 - protein, 7 aa, Artificial Sequence
  Description of Artificial Sequence: Synthetic peptide
AASSLQS

SEQ ID NO: 11575 - protein, 7 aa, Artificial Sequence
  Description of Artificial Sequence: Synthetic peptide
AASSLQS

SEQ ID NO: 11576 - protein, 7 aa, Artificial Sequence
  Description of Artificial Sequence: Synthetic peptide
AASSLQG

SEQ ID NO: 11577 - protein, 7 aa, Artificial Sequence
  Description of Artificial Sequence: Synthetic peptide
AASSLQS

SEQ ID NO: 11578 - protein, 7 aa, Artificial Sequence
  Description of Artificial Sequence: Synthetic peptide
AASSLQS

SEQ ID NO: 11579 - protein, 7 aa, Artificial Sequence
  Description of Artificial Sequence: Synthetic peptide
AASSLQG

SEQ ID NO: 11580 - protein, 7 aa, Artificial Sequence
  Description of Artificial Sequence: Synthetic peptide
AASSLQG

SEQ ID NO: 11581 - protein, 7 aa, Artificial Sequence
  Description of Artificial Sequence: Synthetic peptide
AASSLQG

SEQ ID NO: 11582 - protein, 7 aa, Artificial Sequence
  Description of Artificial Sequence: Synthetic peptide
AASSLQG

SEQ ID NO: 11583 - protein, 7 aa, Artificial Sequence
  Description of Artificial Sequence: Synthetic peptide
AASSLQG

SEQ ID NO: 11584 - protein, 7 aa, Artificial Sequence
  Description of Artificial Sequence: Synthetic peptide
AASSLQS

SEQ ID NO: 11585 - protein, 7 aa, Artificial Sequence
  Description of Artificial Sequence: Synthetic peptide
AASSLQG

SEQ ID NO: 11586 - protein, 7 aa, Artificial Sequence
  Description of Artificial Sequence: Synthetic peptide
AASSLQG

SEQ ID NO: 11587 - protein, 7 aa, Artificial Sequence
  Description of Artificial Sequence: Synthetic peptide
AASSLQS

SEQ ID NO: 11588 - protein, 7 aa, Artificial Sequence
  Description of Artificial Sequence: Synthetic peptide
AASSLQS

SEQ ID NO: 11589 - protein, 7 aa, Artificial Sequence
  Description of Artificial Sequence: Synthetic peptide
AASSLQS

SEQ ID NO: 11590 - protein, 7 aa, Artificial Sequence
  Description of Artificial Sequence: Synthetic peptide
GASSRAT

SEQ ID NO: 11591 - protein, 7 aa, Artificial Sequence
  Description of Artificial Sequence: Synthetic peptide
LGSNRAS

SEQ ID NO: 11592 - protein, 7 aa, Artificial Sequence
  Description of Artificial Sequence: Synthetic peptide
AASTLQS

SEQ ID NO: 11593 - protein, 7 aa, Artificial Sequence
  Description of Artificial Sequence: Synthetic peptide
AASTLQS

SEQ ID NO: 11594 - protein, 7 aa, Artificial Sequence
  Description of Artificial Sequence: Synthetic peptide
WASTRES

SEQ ID NO: 11595 - protein, 7 aa, Artificial Sequence
  Description of Artificial Sequence: Synthetic peptide
WASTRES

SEQ ID NO: 11596 - protein, 7 aa, Artificial Sequence
  Description of Artificial Sequence: Synthetic peptide
WASTRES

SEQ ID NO: 11597 - protein, 7 aa, Artificial Sequence
  Description of Artificial Sequence: Synthetic peptide
AASSLQS

SEQ ID NO: 11598 - protein, 7 aa, Artificial Sequence
  Description of Artificial Sequence: Synthetic peptide
AASSLQS

SEQ ID NO: 11599 - protein, 7 aa, Artificial Sequence
  Description of Artificial Sequence: Synthetic peptide
EVSNRPS

SEQ ID NO: 11600 - protein, 7 aa, Artificial Sequence
  Description of Artificial Sequence: Synthetic peptide
EVSKRPS

SEQ ID NO: 11601 - protein, 7 aa, Artificial Sequence
  Description of Artificial Sequence: Synthetic peptide
RNNQRPS

SEQ ID NO: 11602 - protein, 7 aa, Artificial Sequence
  Description of Artificial Sequence: Synthetic peptide
RNNQRPS

SEQ ID NO: 11603 - protein, 7 aa, Artificial Sequence
  Description of Artificial Sequence: Synthetic peptide
RNNNRPS

SEQ ID NO: 11604 - protein, 7 aa, Artificial Sequence
  Description of Artificial Sequence: Synthetic peptide
RNNNRPS

SEQ ID NO: 11605 - protein, 7 aa, Artificial Sequence
  Description of Artificial Sequence: Synthetic peptide
RNNNRPS

SEQ ID NO: 11606 - protein, 7 aa, Artificial Sequence
  Description of Artificial Sequence: Synthetic peptide
EVSKRPS

SEQ ID NO: 11607 - protein, 7 aa, Artificial Sequence
  Description of Artificial Sequence: Synthetic peptide
EVSKRPS

SEQ ID NO: 11608 - protein, 7 aa, Artificial Sequence
  Description of Artificial Sequence: Synthetic peptide
RNNNRPS

SEQ ID NO: 11609 - protein, 7 aa, Artificial Sequence
  Description of Artificial Sequence: Synthetic peptide
RNNNRPS

SEQ ID NO: 11610 - protein, 7 aa, Artificial Sequence
  Description of Artificial Sequence: Synthetic peptide
YDSDRPS

SEQ ID NO: 11611 - protein, 7 aa, Artificial Sequence
  Description of Artificial Sequence: Synthetic peptide
DDNDRPS

SEQ ID NO: 11612 - protein, 7 aa, Artificial Sequence
  Description of Artificial Sequence: Synthetic peptide
DDNDRPS

SEQ ID NO: 11613 - protein, 7 aa, Artificial Sequence
  Description of Artificial Sequence: Synthetic peptide
DDNDRPS

SEQ ID NO: 11614 - protein, 7 aa, Artificial Sequence
  Description of Artificial Sequence: Synthetic peptide
DDNDRPS

SEQ ID NO: 11615 - protein, 7 aa, Artificial Sequence
  Description of Artificial Sequence: Synthetic peptide
DDNDRPS

SEQ ID NO: 11616 - protein, 7 aa, Artificial Sequence
  Description of Artificial Sequence: Synthetic peptide
DDNDRPS

SEQ ID NO: 11617 - protein, 7 aa, Artificial Sequence
  Description of Artificial Sequence: Synthetic peptide
DDNDRPS

SEQ ID NO: 11618 - protein, 7 aa, Artificial Sequence
  Description of Artificial Sequence: Synthetic peptide
DDNDRPS

SEQ ID NO: 11619 - protein, 7 aa, Artificial Sequence
  Description of Artificial Sequence: Synthetic peptide
DDNDRPS

SEQ ID NO: 11620 - protein, 7 aa, Artificial Sequence
  Description of Artificial Sequence: Synthetic peptide
DDNDRPS

SEQ ID NO: 11621 - protein, 7 aa, Artificial Sequence
  Description of Artificial Sequence: Synthetic peptide
DDNDRPS

SEQ ID NO: 11622 - protein, 7 aa, Artificial Sequence
  Description of Artificial Sequence: Synthetic peptide
DDNDRPS

SEQ ID NO: 11623 - protein, 7 aa, Artificial Sequence
  Description of Artificial Sequence: Synthetic peptide
DDNDRPS

SEQ ID NO: 11624 - protein, 7 aa, Artificial Sequence
  Description of Artificial Sequence: Synthetic peptide
DDNDRPS

SEQ ID NO: 11625 - protein, 7 aa, Artificial Sequence
  Description of Artificial Sequence: Synthetic peptide
DDNDRPS

SEQ ID NO: 11626 - protein, 7 aa, Artificial Sequence
  Description of Artificial Sequence: Synthetic peptide
DDNDRPS

SEQ ID NO: 11627 - protein, 7 aa, Artificial Sequence
  Description of Artificial Sequence: Synthetic peptide
DDNDRPS

SEQ ID NO: 11628 - protein, 7 aa, Artificial Sequence
  Description of Artificial Sequence: Synthetic peptide
DDNDRPS

SEQ ID NO: 11629 - protein, 7 aa, Artificial Sequence
  Description of Artificial Sequence: Synthetic peptide
DDNDRPS

SEQ ID NO: 11630 - protein, 7 aa, Artificial Sequence
  Description of Artificial Sequence: Synthetic peptide
DDNDRPS

SEQ ID NO: 11631 - protein, 7 aa, Artificial Sequence
  Description of Artificial Sequence: Synthetic peptide
DDNDRPS

SEQ ID NO: 11632 - protein, 7 aa, Artificial Sequence
  Description of Artificial Sequence: Synthetic peptide
DDNDRPS

SEQ ID NO: 11633 - protein, 7 aa, Artificial Sequence
  Description of Artificial Sequence: Synthetic peptide
DDNDRPS

SEQ ID NO: 11634 - protein, 7 aa, Artificial Sequence
  Description of Artificial Sequence: Synthetic peptide
DDNDRPS

SEQ ID NO: 11635 - protein, 7 aa, Artificial Sequence
  Description of Artificial Sequence: Synthetic peptide
DDNDRPS

SEQ ID NO: 11636 - protein, 7 aa, Artificial Sequence
  Description of Artificial Sequence: Synthetic peptide
DDNDRPS

SEQ ID NO: 11637 - protein, 7 aa, Artificial Sequence
  Description of Artificial Sequence: Synthetic peptide
DDNDRPS

SEQ ID NO: 11638 - protein, 7 aa, Artificial Sequence
  Description of Artificial Sequence: Synthetic peptide
DDNDRPS

SEQ ID NO: 11639 - protein, 7 aa, Artificial Sequence
  Description of Artificial Sequence: Synthetic peptide
DDNDRPS

SEQ ID NO: 11640 - protein, 7 aa, Artificial Sequence
  Description of Artificial Sequence: Synthetic peptide
DDNDRPS

SEQ ID NO: 11641 - protein, 7 aa, Artificial Sequence
  Description of Artificial Sequence: Synthetic peptide
DDNDRPS

SEQ ID NO: 11642 - protein, 7 aa, Artificial Sequence
  Description of Artificial Sequence: Synthetic peptide
DDNDRPS

SEQ ID NO: 11643 - protein, 7 aa, Artificial Sequence
  Description of Artificial Sequence: Synthetic peptide
DDNDRPS

SEQ ID NO: 11644 - protein, 7 aa, Artificial Sequence
  Description of Artificial Sequence: Synthetic peptide
DDNDRPS

SEQ ID NO: 11645 - protein, 7 aa, Artificial Sequence
  Description of Artificial Sequence: Synthetic peptide
DDSDRPS

SEQ ID NO: 11646 - protein, 7 aa, Artificial Sequence
  Description of Artificial Sequence: Synthetic peptide
DDNDRPS

SEQ ID NO: 11647 - protein, 7 aa, Artificial Sequence
  Description of Artificial Sequence: Synthetic peptide
DDNDRPS

SEQ ID NO: 11648 - protein, 7 aa, Artificial Sequence
  Description of Artificial Sequence: Synthetic peptide
DDNDRPS

SEQ ID NO: 11649 - protein, 7 aa, Artificial Sequence
  Description of Artificial Sequence: Synthetic peptide
DDNDRPS

SEQ ID NO: 11650 - protein, 7 aa, Artificial Sequence
  Description of Artificial Sequence: Synthetic peptide
DDNDRPS

SEQ ID NO: 11651 - protein, 7 aa, Artificial Sequence
  Description of Artificial Sequence: Synthetic peptide
DDNDRPS

SEQ ID NO: 11652 - protein, 7 aa, Artificial Sequence
  Description of Artificial Sequence: Synthetic peptide
DDNDRPS

SEQ ID NO: 11653 - protein, 7 aa, Artificial Sequence
  Description of Artificial Sequence: Synthetic peptide
DDNDRPS

SEQ ID NO: 11654 - protein, 7 aa, Artificial Sequence
  Description of Artificial Sequence: Synthetic peptide
DDNDRPS

SEQ ID NO: 11655 - protein, 7 aa, Artificial Sequence
  Description of Artificial Sequence: Synthetic peptide
DDNDRPS

SEQ ID NO: 11656 - protein, 7 aa, Artificial Sequence
  Description of Artificial Sequence: Synthetic peptide
DDNDRPS

SEQ ID NO: 11657 - protein, 7 aa, Artificial Sequence
  Description of Artificial Sequence: Synthetic peptide
DDNDRPS

SEQ ID NO: 11658 - protein, 7 aa, Artificial Sequence
  Description of Artificial Sequence: Synthetic peptide
DDNDRPS

SEQ ID NO: 11659 - protein, 7 aa, Artificial Sequence
  Description of Artificial Sequence: Synthetic peptide
DDNDRPS

SEQ ID NO: 11660 - protein, 7 aa, Artificial Sequence
  Description of Artificial Sequence: Synthetic peptide
DDADRPS

SEQ ID NO: 11661 - protein, 7 aa, Artificial Sequence
  Description of Artificial Sequence: Synthetic peptide
DDNDRPS

SEQ ID NO: 11662 - protein, 7 aa, Artificial Sequence
  Description of Artificial Sequence: Synthetic peptide
DDNDRPS

SEQ ID NO: 11663 - protein, 7 aa, Artificial Sequence
  Description of Artificial Sequence: Synthetic peptide
DDNDRPS

SEQ ID NO: 11664 - protein, 7 aa, Artificial Sequence
  Description of Artificial Sequence: Synthetic peptide
DDNDRPS

SEQ ID NO: 11665 - protein, 7 aa, Artificial Sequence
  Description of Artificial Sequence: Synthetic peptide
DDNDRPS

SEQ ID NO: 11666 - protein, 7 aa, Artificial Sequence
  Description of Artificial Sequence: Synthetic peptide
DDNDRPS

SEQ ID NO: 11667 - protein, 7 aa, Artificial Sequence
  Description of Artificial Sequence: Synthetic peptide
DDNDRPS

SEQ ID NO: 11668 - protein, 7 aa, Artificial Sequence
  Description of Artificial Sequence: Synthetic peptide
DDNDRPS

SEQ ID NO: 11669 - protein, 7 aa, Artificial Sequence
  Description of Artificial Sequence: Synthetic peptide
YDSDRPS

SEQ ID NO: 11670 - protein, 7 aa, Artificial Sequence
  Description of Artificial Sequence: Synthetic peptide
DDNDRPS

SEQ ID NO: 11671 - protein, 7 aa, Artificial Sequence
  Description of Artificial Sequence: Synthetic peptide
DDNDRPS

SEQ ID NO: 11672 - protein, 17 aa, Artificial Sequence
  Description of Artificial Sequence: Synthetic peptide
LVDPEDGETIYAEKFQG

SEQ ID NO: 11673 - protein, 17 aa, Artificial Sequence
  Description of Artificial Sequence: Synthetic peptide
RIYPGDGDTNYNGKFKG

SEQ ID NO: 11674 - protein, 17 aa, Artificial Sequence
  Description of Artificial Sequence: Synthetic peptide
GIIPIFGTANYAQKFQG

SEQ ID NO: 11675 - protein, 17 aa, Artificial Sequence
  Description of Artificial Sequence: Synthetic peptide
RVWPGDGDTTYNEKFKG

SEQ ID NO: 11676 - protein, 17 aa, Artificial Sequence
  Description of Artificial Sequence: Synthetic peptide
GIIPIFGTANYAQKFQG

SEQ ID NO: 11677 - protein, 17 aa, Artificial Sequence
  Description of Artificial Sequence: Synthetic peptide
RIYPGDGDTNYNGKFKD

SEQ ID NO: 11678 - protein, 17 aa, Artificial Sequence
  Description of Artificial Sequence: Synthetic peptide
WMNPNSGNTGYAQKFQG

SEQ ID NO: 11679 - protein, 17 aa, Artificial Sequence
  Description of Artificial Sequence: Synthetic peptide
WMNPNSGNTGYAQKFQG

SEQ ID NO: 11680 - protein, 17 aa, Artificial Sequence
  Description of Artificial Sequence: Synthetic peptide
WMNPNSGNTGYAQKFQG

SEQ ID NO: 11681 - protein, 17 aa, Artificial Sequence
  Description of Artificial Sequence: Synthetic peptide
WMNPNSGNTGYAQKFQG

SEQ ID NO: 11682 - protein, 17 aa, Artificial Sequence
  Description of Artificial Sequence: Synthetic peptide
WMNPNSGNTGYAQKFQG

SEQ ID NO: 11683 - protein, 17 aa, Artificial Sequence
  Description of Artificial Sequence: Synthetic peptide
WMNPNRGTTGYAQKFQG

SEQ ID NO: 11684 - protein, 17 aa, Artificial Sequence
  Description of Artificial Sequence: Synthetic peptide
WMNPNSGNTGYAQKFQG

SEQ ID NO: 11685 - protein, 16 aa, Artificial Sequence
  Description of Artificial Sequence: Synthetic peptide
EINHSGSTNYNPSLKS

SEQ ID NO: 11686 - protein, 16 aa, Artificial Sequence
  Description of Artificial Sequence: Synthetic peptide
EISHSGSTNYNPSLKS

SEQ ID NO: 11687 - protein, 16 aa, Artificial Sequence
  Description of Artificial Sequence: Synthetic peptide
EINHSGRTNYNPSLKS

SEQ ID NO: 11688 - protein, 16 aa, Artificial Sequence
  Description of Artificial Sequence: Synthetic peptide
EINHRGSTNYNPSLKS

SEQ ID NO: 11689 - protein, 16 aa, Artificial Sequence
  Description of Artificial Sequence: Synthetic peptide
EINHSGSTTYNPSLKS

SEQ ID NO: 11690 - protein, 16 aa, Artificial Sequence
  Description of Artificial Sequence: Synthetic peptide
EINHRGSTNYNPSLKS

SEQ ID NO: 11691 - protein, 16 aa, Artificial Sequence
  Description of Artificial Sequence: Synthetic peptide
EISHSGSTNYNPSLKS

SEQ ID NO: 11692 - protein, 16 aa, Artificial Sequence
  Description of Artificial Sequence: Synthetic peptide
EINHSGSTNYNPSLKS

SEQ ID NO: 11693 - protein, 16 aa, Artificial Sequence
  Description of Artificial Sequence: Synthetic peptide
EITHSGSTNYNPSLKS

SEQ ID NO: 11694 - protein, 16 aa, Artificial Sequence
  Description of Artificial Sequence: Synthetic peptide
EINHSGRTNYNPSLKS

SEQ ID NO: 11695 - protein, 16 aa, Artificial Sequence
  Description of Artificial Sequence: Synthetic peptide
EINHRGSTNYNPSLKS

SEQ ID NO: 11696 - protein, 17 aa, Artificial Sequence
  Description of Artificial Sequence: Synthetic peptide
AISGSGGSTYYADSVKG

SEQ ID NO: 11697 - protein, 17 aa, Artificial Sequence
  Description of Artificial Sequence: Synthetic peptide
AISGSGDITYYADSVKG

SEQ ID NO: 11698 - protein, 17 aa, Artificial Sequence
  Description of Artificial Sequence: Synthetic peptide
AISGSGDYTYYADSVKG

SEQ ID NO: 11699 - protein, 17 aa, Artificial Sequence
  Description of Artificial Sequence: Synthetic peptide
AISGSGDITYYADSVKG

SEQ ID NO: 11700 - protein, 17 aa, Artificial Sequence
  Description of Artificial Sequence: Synthetic peptide
AISGSGSSTYYADSVKG

SEQ ID NO: 11701 - protein, 17 aa, Artificial Sequence
  Description of Artificial Sequence: Synthetic peptide
AISGSGDITYYADSVKG

SEQ ID NO: 11702 - protein, 17 aa, Artificial Sequence
  Description of Artificial Sequence: Synthetic peptide
VISYDGSNKYYADSVKG

SEQ ID NO: 11703 - protein, 17 aa, Artificial Sequence
  Description of Artificial Sequence: Synthetic peptide
VISYDGGNKYYADSVKG

SEQ ID NO: 11704 - protein, 17 aa, Artificial Sequence
  Description of Artificial Sequence: Synthetic peptide
VISYDGSNKYYADSVKG

SEQ ID NO: 11705 - protein, 16 aa, Artificial Sequence
  Description of Artificial Sequence: Synthetic peptide
EINHSGSTNYNPSLKS

SEQ ID NO: 11706 - protein, 16 aa, Artificial Sequence
  Description of Artificial Sequence: Synthetic peptide
EINHSGSTNYNPSLKS

SEQ ID NO: 11707 - protein, 16 aa, Artificial Sequence
  Description of Artificial Sequence: Synthetic peptide
EINHSGSTNYNPSLKS

SEQ ID NO: 11708 - protein, 16 aa, Artificial Sequence
  Description of Artificial Sequence: Synthetic peptide
EINHRGSTNYNPSLKS

SEQ ID NO: 11709 - protein, 16 aa, Artificial Sequence
  Description of Artificial Sequence: Synthetic peptide
EINHSGSTNYNPSLKS

SEQ ID NO: 11710 - protein, 16 aa, Artificial Sequence
  Description of Artificial Sequence: Synthetic peptide
EINHSGSTNYNPSLKS

SEQ ID NO: 11711 - protein, 16 aa, Artificial Sequence
  Description of Artificial Sequence: Synthetic peptide
EINHSGSTNYNPSLKS

SEQ ID NO: 11712 - protein, 16 aa, Artificial Sequence
  Description of Artificial Sequence: Synthetic peptide
EINHSGSTNYNPSLKS

SEQ ID NO: 11713 - protein, 16 aa, Artificial Sequence
  Description of Artificial Sequence: Synthetic peptide
EINHSGSTNYNPSLKS

SEQ ID NO: 11714 - protein, 16 aa, Artificial Sequence
  Description of Artificial Sequence: Synthetic peptide
EINHSGSTNYNPSLKS

SEQ ID NO: 11715 - protein, 17 aa, Artificial Sequence
  Description of Artificial Sequence: Synthetic peptide
AISGSGGSTYYADSVKG

SEQ ID NO: 11716 - protein, 17 aa, Artificial Sequence
  Description of Artificial Sequence: Synthetic peptide
TISGSGGSTDYADSVKG

SEQ ID NO: 11717 - protein, 17 aa, Artificial Sequence
  Description of Artificial Sequence: Synthetic peptide
SITITGGSTYYADSVKG

SEQ ID NO: 11718 - protein, 17 aa, Artificial Sequence
  Description of Artificial Sequence: Synthetic peptide
TISHSGGSTYYADSVKG

SEQ ID NO: 11719 - protein, 17 aa, Artificial Sequence
  Description of Artificial Sequence: Synthetic peptide
TISISGGSTNYADSVKG

SEQ ID NO: 11720 - protein, 17 aa, Artificial Sequence
  Description of Artificial Sequence: Synthetic peptide
AISGSGGSTYYADSVKG

SEQ ID NO: 11721 - protein, 17 aa, Artificial Sequence
  Description of Artificial Sequence: Synthetic peptide
AISGSGGSTYYADSAKG

SEQ ID NO: 11722 - protein, 17 aa, Artificial Sequence
  Description of Artificial Sequence: Synthetic peptide
AISGSGGSTYYADSVKG

SEQ ID NO: 11723 - protein, 17 aa, Artificial Sequence
  Description of Artificial Sequence: Synthetic peptide
AISGSGGSTYYADSVKG

SEQ ID NO: 11724 - protein, 17 aa, Artificial Sequence
  Description of Artificial Sequence: Synthetic peptide
AISGSGGSTYYADSVKG

SEQ ID NO: 11725 - protein, 17 aa, Artificial Sequence
  Description of Artificial Sequence: Synthetic peptide
AISGSGGSTYYADSVKG

SEQ ID NO: 11726 - protein, 17 aa, Artificial Sequence
  Description of Artificial Sequence: Synthetic peptide
AISGSGGSTYYADSVKG

SEQ ID NO: 11727 - protein, 17 aa, Artificial Sequence
  Description of Artificial Sequence: Synthetic peptide
GISGSGGSTYYADSVKG

SEQ ID NO: 11728 - protein, 16 aa, Artificial Sequence
  Description of Artificial Sequence: Synthetic peptide
YIYYSGSTYYNPSLKS

SEQ ID NO: 11729 - protein, 16 aa, Artificial Sequence
  Description of Artificial Sequence: Synthetic peptide
YIYYSGSTYYNPSLKS

SEQ ID NO: 11730 - protein, 16 aa, Artificial Sequence
  Description of Artificial Sequence: Synthetic peptide
YINDSGSTYYNPSLKS

SEQ ID NO: 11731 - protein, 16 aa, Artificial Sequence
  Description of Artificial Sequence: Synthetic peptide
YISYSGSTFYNPSLKS

SEQ ID NO: 11732 - protein, 16 aa, Artificial Sequence
  Description of Artificial Sequence: Synthetic peptide
YIDKSGSTYYNPSLKS

SEQ ID NO: 11733 - protein, 16 aa, Artificial Sequence
  Description of Artificial Sequence: Synthetic peptide
YIDKSGSTYYNPSLKS

SEQ ID NO: 11734 - protein, 16 aa, Artificial Sequence
  Description of Artificial Sequence: Synthetic peptide
YIDKSGSTYYNPSLKS

SEQ ID NO: 11735 - protein, 16 aa, Artificial Sequence
  Description of Artificial Sequence: Synthetic peptide
YIDKSGSTYYNPSLKS

SEQ ID NO: 11736 - protein, 16 aa, Artificial Sequence
  Description of Artificial Sequence: Synthetic peptide
YISHSGSTYYNPSLKS

SEQ ID NO: 11737 - protein, 16 aa, Artificial Sequence
  Description of Artificial Sequence: Synthetic peptide
YISYSGSTFYNPSLKS

SEQ ID NO: 11738 - protein, 16 aa, Artificial Sequence
  Description of Artificial Sequence: Synthetic peptide
YIDKSGSTYYNPSLKS

SEQ ID NO: 11739 - protein, 16 aa, Artificial Sequence
  Description of Artificial Sequence: Synthetic peptide
YIDKSGSTYYNPSLKS

SEQ ID NO: 11740 - protein, 16 aa, Artificial Sequence
  Description of Artificial Sequence: Synthetic peptide
YIYYSGSTSYNPSLKS

SEQ ID NO: 11741 - protein, 16 aa, Artificial Sequence
  Description of Artificial Sequence: Synthetic peptide
YIDKSGSTYYNPSLKS

SEQ ID NO: 11742 - protein, 16 aa, Artificial Sequence
  Description of Artificial Sequence: Synthetic peptide
YISYSGSTYYNPSLKS

SEQ ID NO: 11743 - protein, 16 aa, Artificial Sequence
  Description of Artificial Sequence: Synthetic peptide
YISYSGSTYYNPSLKS

SEQ ID NO: 11744 - protein, 16 aa, Artificial Sequence
  Description of Artificial Sequence: Synthetic peptide
YISYSGSTFYNPSLKS

SEQ ID NO: 11745 - protein, 16 aa, Artificial Sequence
  Description of Artificial Sequence: Synthetic peptide
YISHSGSTYYNPSLKS

SEQ ID NO: 11746 - protein, 16 aa, Artificial Sequence
  Description of Artificial Sequence: Synthetic peptide
YISYSGSTFYNPSLKS

SEQ ID NO: 11747 - protein, 17 aa, Artificial Sequence
  Description of Artificial Sequence: Synthetic peptide
AISGSGGSTYYADSVKG

SEQ ID NO: 11748 - protein, 17 aa, Artificial Sequence
  Description of Artificial Sequence: Synthetic peptide
AISGSGGSTYYADSVKG

SEQ ID NO: 11749 - protein, 17 aa, Artificial Sequence
  Description of Artificial Sequence: Synthetic peptide
VIWYDGSNKYYADSVKG

SEQ ID NO: 11750 - protein, 17 aa, Artificial Sequence
  Description of Artificial Sequence: Synthetic peptide
LIWYDGSNKYYADSVKG

SEQ ID NO: 11751 - protein, 17 aa, Artificial Sequence
  Description of Artificial Sequence: Synthetic peptide
VIWYDGSNKYYADSVKG

SEQ ID NO: 11752 - protein, 17 aa, Artificial Sequence
  Description of Artificial Sequence: Synthetic peptide
WMNPNSGNTGYAQKFQG

SEQ ID NO: 11753 - protein, 17 aa, Artificial Sequence
  Description of Artificial Sequence: Synthetic peptide
WMNPNSGNTDYAQKFQG

SEQ ID NO: 11754 - protein, 17 aa, Artificial Sequence
  Description of Artificial Sequence: Synthetic peptide
WMNPNSGNTDYAQKFQG

SEQ ID NO: 11755 - protein, 17 aa, Artificial Sequence
  Description of Artificial Sequence: Synthetic peptide
WMNPNSGNTDYAQKFQG

SEQ ID NO: 11756 - protein, 17 aa, Artificial Sequence
  Description of Artificial Sequence: Synthetic peptide
WMNPNSGNTDYTQKFQG

SEQ ID NO: 11757 - protein, 17 aa, Artificial Sequence
  Description of Artificial Sequence: Synthetic peptide
WMNPKSGNTGYAQKFQD

SEQ ID NO: 11758 - protein, 17 aa, Artificial Sequence
  Description of Artificial Sequence: Synthetic peptide
SISSSSSYIYYADSVKG

SEQ ID NO: 11759 - protein, 17 aa, Artificial Sequence
  Description of Artificial Sequence: Synthetic peptide
SISSSSSYIYYADSVKG

SEQ ID NO: 11760 - protein, 17 aa, Artificial Sequence
  Description of Artificial Sequence: Synthetic peptide
VISYDGSNKYYADSVKG

SEQ ID NO: 11761 - protein, 17 aa, Artificial Sequence
  Description of Artificial Sequence: Synthetic peptide
VISYDGSNKYYADSVKG

SEQ ID NO: 11762 - protein, 17 aa, Artificial Sequence
  Description of Artificial Sequence: Synthetic peptide
VISYDGSNKYYADSVKG

SEQ ID NO: 11763 - protein, 16 aa, Artificial Sequence
  Description of Artificial Sequence: Synthetic peptide
YIYYSGSTNYNPSLKS

SEQ ID NO: 11764 - protein, 16 aa, Artificial Sequence
  Description of Artificial Sequence: Synthetic peptide
SIYYSGSTYYNPSLKS

SEQ ID NO: 11765 - protein, 16 aa, Artificial Sequence
  Description of Artificial Sequence: Synthetic peptide
SIYYSGSTYYNPSLKS

SEQ ID NO: 11766 - protein, 16 aa, Artificial Sequence
  Description of Artificial Sequence: Synthetic peptide
SIYYSGSTYYNPSLKS

SEQ ID NO: 11767 - protein, 16 aa, Artificial Sequence
  Description of Artificial Sequence: Synthetic peptide
SIYYSGSTYYNPSLKS

SEQ ID NO: 11768 - protein, 18 aa, Artificial Sequence
  Description of Artificial Sequence: Synthetic peptide
RTYYRSKWYNDYAVSVKS

SEQ ID NO: 11769 - protein, 18 aa, Artificial Sequence
  Description of Artificial Sequence: Synthetic peptide
RTYYRSKWYNDYAVSVKS

SEQ ID NO: 11770 - protein, 16 aa, Artificial Sequence
  Description of Artificial Sequence: Synthetic peptide
SIYHSGSTYYNPSLKS

SEQ ID NO: 11771 - protein, 16 aa, Artificial Sequence
  Description of Artificial Sequence: Synthetic peptide
SIYYGGSTYYNPSLKS

SEQ ID NO: 11772 - protein, 16 aa, Artificial Sequence
  Description of Artificial Sequence: Synthetic peptide
RIDWDDDKFYSTSLKT

SEQ ID NO: 11773 - protein, 16 aa, Artificial Sequence
  Description of Artificial Sequence: Synthetic peptide
LIYWNDDTRYSPSLQS

SEQ ID NO: 11774 - protein, 16 aa, Artificial Sequence
  Description of Artificial Sequence: Synthetic peptide
LIYWNDDKRYSPSLKS

SEQ ID NO: 11775 - protein, 16 aa, Artificial Sequence
  Description of Artificial Sequence: Synthetic peptide
LIYWNDDKRYSPSLQS

SEQ ID NO: 11776 - protein, 17 aa, Artificial Sequence
  Description of Artificial Sequence: Synthetic peptide
AISGSGGSTYYADSVKG

SEQ ID NO: 11777 - protein, 17 aa, Artificial Sequence
  Description of Artificial Sequence: Synthetic peptide
AISGSGGSTYYADSVKG

SEQ ID NO: 11778 - protein, 16 aa, Artificial Sequence
  Description of Artificial Sequence: Synthetic peptide
YIYYSGSTNYNPSLKS

SEQ ID NO: 11779 - protein, 16 aa, Artificial Sequence
  Description of Artificial Sequence: Synthetic peptide
SIYYGGSTYYNPSLKN

SEQ ID NO: 11780 - protein, 16 aa, Artificial Sequence
  Description of Artificial Sequence: Synthetic peptide
LIYWNDDKRYSPSLKS

SEQ ID NO: 11781 - protein, 16 aa, Artificial Sequence
  Description of Artificial Sequence: Synthetic peptide
LIYWNDDKRYSPSLQS

SEQ ID NO: 11782 - protein, 16 aa, Artificial Sequence
  Description of Artificial Sequence: Synthetic peptide
LIYWNDDKRYNPSLQS

SEQ ID NO: 11783 - protein, 16 aa, Artificial Sequence
  Description of Artificial Sequence: Synthetic peptide
LIYWNDDKRYSPSLQS

SEQ ID NO: 11784 - protein, 16 aa, Artificial Sequence
  Description of Artificial Sequence: Synthetic peptide
LIYWNDDKRYSPSLQS

SEQ ID NO: 11785 - protein, 16 aa, Artificial Sequence
  Description of Artificial Sequence: Synthetic peptide
LIYWNDDKRYSPSLQS

SEQ ID NO: 11786 - protein, 16 aa, Artificial Sequence
  Description of Artificial Sequence: Synthetic peptide
LIYWNDDKRYSPSLQS

SEQ ID NO: 11787 - protein, 16 aa, Artificial Sequence
  Description of Artificial Sequence: Synthetic peptide
LIYWNDDKRYSPSLQS

SEQ ID NO: 11788 - protein, 16 aa, Artificial Sequence
  Description of Artificial Sequence: Synthetic peptide
GIHIYDDKRYSPSLQS

SEQ ID NO: 11789 - protein, 16 aa, Artificial Sequence
  Description of Artificial Sequence: Synthetic peptide
LIYWNDDKRYSPSLQS

SEQ ID NO: 11790 - protein, 16 aa, Artificial Sequence
  Description of Artificial Sequence: Synthetic peptide
LIYWNDDKRYSPSLQS

SEQ ID NO: 11791 - protein, 17 aa, Artificial Sequence
  Description of Artificial Sequence: Synthetic peptide
AISGSGGSTYYADSVKG

SEQ ID NO: 11792 - protein, 17 aa, Artificial Sequence
  Description of Artificial Sequence: Synthetic peptide
GISGSGGSSYYADSVKG

SEQ ID NO: 11793 - protein, 17 aa, Artificial Sequence
  Description of Artificial Sequence: Synthetic peptide
GISGSGGSTYYADSVKG

SEQ ID NO: 11794 - protein, 16 aa, Artificial Sequence
  Description of Artificial Sequence: Synthetic peptide
YIYYSGSTYYNPSLKS

SEQ ID NO: 11795 - protein, 16 aa, Artificial Sequence
  Description of Artificial Sequence: Synthetic peptide
YIDKSGSTYYNPSLKS

SEQ ID NO: 11796 - protein, 16 aa, Artificial Sequence
  Description of Artificial Sequence: Synthetic peptide
YISHSGSTYYNPSLKS

SEQ ID NO: 11797 - protein, 16 aa, Artificial Sequence
  Description of Artificial Sequence: Synthetic peptide
YISHSGSTYYNPSLKS

SEQ ID NO: 11798 - protein, 16 aa, Artificial Sequence
  Description of Artificial Sequence: Synthetic peptide
YISYSGITNYNPSLKS

SEQ ID NO: 11799 - protein, 16 aa, Artificial Sequence
  Description of Artificial Sequence: Synthetic peptide
YISHSGSTYYNPSLKS

SEQ ID NO: 11800 - protein, 16 aa, Artificial Sequence
  Description of Artificial Sequence: Synthetic peptide
YISYSGITNYNPSLKS

SEQ ID NO: 11801 - protein, 19 aa, Artificial Sequence
  Description of Artificial Sequence: Synthetic peptide
RIKSKTDGGTTDYAAPVKG

SEQ ID NO: 11802 - protein, 19 aa, Artificial Sequence
  Description of Artificial Sequence: Synthetic peptide
RIKGNTYGGTTDYAAPVKG

SEQ ID NO: 11803 - protein, 19 aa, Artificial Sequence
  Description of Artificial Sequence: Synthetic peptide
RIKGNTYGGTTDYAAPVKG

SEQ ID NO: 11804 - protein, 19 aa, Artificial Sequence
  Description of Artificial Sequence: Synthetic peptide
RIKGNTYGGTTDYAAPVKG

SEQ ID NO: 11805 - protein, 19 aa, Artificial Sequence
  Description of Artificial Sequence: Synthetic peptide
RIKGNTYGGTTDYAAPVKG

SEQ ID NO: 11806 - protein, 19 aa, Artificial Sequence
  Description of Artificial Sequence: Synthetic peptide
RIKGNTYGGTTDYAAPVKG

SEQ ID NO: 11807 - protein, 19 aa, Artificial Sequence
  Description of Artificial Sequence: Synthetic peptide
RIKGNTYGGTTDYAAPVKG

SEQ ID NO: 11808 - protein, 19 aa, Artificial Sequence
  Description of Artificial Sequence: Synthetic peptide
RIKGNTYGGTTDYAAPVKG

SEQ ID NO: 11809 - protein, 19 aa, Artificial Sequence
  Description of Artificial Sequence: Synthetic peptide
RIKSKTYGGTTDYAAPVKG

SEQ ID NO: 11810 - protein, 19 aa, Artificial Sequence
  Description of Artificial Sequence: Synthetic peptide
RIKGNTYGGTTDYAAPVKG

SEQ ID NO: 11811 - protein, 19 aa, Artificial Sequence
  Description of Artificial Sequence: Synthetic peptide
RIKGNTYGGTTDYAAPVKG

SEQ ID NO: 11812 - protein, 19 aa, Artificial Sequence
  Description of Artificial Sequence: Synthetic peptide
RIKGNTYGGTTDYAAPVKG

SEQ ID NO: 11813 - protein, 19 aa, Artificial Sequence
  Description of Artificial Sequence: Synthetic peptide
RIKGNTYGGTTDYAAPVKG

SEQ ID NO: 11814 - protein, 19 aa, Artificial Sequence
  Description of Artificial Sequence: Synthetic peptide
RIKGNTYGGTTDYAAPVKG

SEQ ID NO: 11815 - protein, 19 aa, Artificial Sequence
  Description of Artificial Sequence: Synthetic peptide
RIKGNTYGGTTDYAAPVKG

SEQ ID NO: 11816 - protein, 19 aa, Artificial Sequence
  Description of Artificial Sequence: Synthetic peptide
RIKGNTYGGTTDYAAPVKG

SEQ ID NO: 11817 - protein, 19 aa, Artificial Sequence
  Description of Artificial Sequence: Synthetic peptide
RIKGNTYGGTTDYAAPVKG

SEQ ID NO: 11818 - protein, 19 aa, Artificial Sequence
  Description of Artificial Sequence: Synthetic peptide
RIKSKTYGGTTDYAAPVKG

SEQ ID NO: 11819 - protein, 19 aa, Artificial Sequence
  Description of Artificial Sequence: Synthetic peptide
RIRSRSYGGTTDYAAPVKG

SEQ ID NO: 11820 - protein, 19 aa, Artificial Sequence
  Description of Artificial Sequence: Synthetic peptide
RIKSKTYGGTTDYAAPVKG

SEQ ID NO: 11821 - protein, 19 aa, Artificial Sequence
  Description of Artificial Sequence: Synthetic peptide
RITSSRYGGTTDYAAPVKG

SEQ ID NO: 11822 - protein, 19 aa, Artificial Sequence
  Description of Artificial Sequence: Synthetic peptide
RILNNAYGGTTDYAAPVKG

SEQ ID NO: 11823 - protein, 19 aa, Artificial Sequence
  Description of Artificial Sequence: Synthetic peptide
RITSGIYGGTTDYAAPVKG

SEQ ID NO: 11824 - protein, 19 aa, Artificial Sequence
  Description of Artificial Sequence: Synthetic peptide
RIRSRPYGGTTDYAAPVKG

SEQ ID NO: 11825 - protein, 16 aa, Artificial Sequence
  Description of Artificial Sequence: Synthetic peptide
YIYYSGSTNYNPSLKS

SEQ ID NO: 11826 - protein, 16 aa, Artificial Sequence
  Description of Artificial Sequence: Synthetic peptide
HIYTSGSTNYNPSLKS

SEQ ID NO: 11827 - protein, 16 aa, Artificial Sequence
  Description of Artificial Sequence: Synthetic peptide
YIYYRGSTNYHPSLKS

SEQ ID NO: 11828 - protein, 16 aa, Artificial Sequence
  Description of Artificial Sequence: Synthetic peptide
HIYTSGSTNFNPSLKS

SEQ ID NO: 11829 - protein, 17 aa, Artificial Sequence
  Description of Artificial Sequence: Synthetic peptide
AISGSGGSTYYADSVKG

SEQ ID NO: 11830 - protein, 17 aa, Artificial Sequence
  Description of Artificial Sequence: Synthetic peptide
AISGSGGSTYYADSVKG

SEQ ID NO: 11831 - protein, 17 aa, Artificial Sequence
  Description of Artificial Sequence: Synthetic peptide
AISGSGGGTYYADSVKG

SEQ ID NO: 11832 - protein, 17 aa, Artificial Sequence
  Description of Artificial Sequence: Synthetic peptide
TISGSGGGTYYADSVKG

SEQ ID NO: 11833 - protein, 17 aa, Artificial Sequence
  Description of Artificial Sequence: Synthetic peptide
AISGSGGGTYYADSVKG

SEQ ID NO: 11834 - protein, 17 aa, Artificial Sequence
  Description of Artificial Sequence: Synthetic peptide
AISGSGGGTYNADSVKG

SEQ ID NO: 11835 - protein, 17 aa, Artificial Sequence
  Description of Artificial Sequence: Synthetic peptide
AISGSGGGTYYADSVKG

SEQ ID NO: 11836 - protein, 17 aa, Artificial Sequence
  Description of Artificial Sequence: Synthetic peptide
AISGSGGGTYNADSVKG

SEQ ID NO: 11837 - protein, 17 aa, Artificial Sequence
  Description of Artificial Sequence: Synthetic peptide
AISGSGGGTYYADSVKA

SEQ ID NO: 11838 - protein, 17 aa, Artificial Sequence
  Description of Artificial Sequence: Synthetic peptide
AISGSGGGTYYADSVKG

SEQ ID NO: 11839 - protein, 17 aa, Artificial Sequence
  Description of Artificial Sequence: Synthetic peptide
AISGSGGGTYYADSVKG

SEQ ID NO: 11840 - protein, 17 aa, Artificial Sequence
  Description of Artificial Sequence: Synthetic peptide
AISGSGGGTYYADSVKG

SEQ ID NO: 11841 - protein, 17 aa, Artificial Sequence
  Description of Artificial Sequence: Synthetic peptide
AISGSGGGTYYADSVKG

SEQ ID NO: 11842 - protein, 17 aa, Artificial Sequence
  Description of Artificial Sequence: Synthetic peptide
AISGSGGGTYYADSVKG

SEQ ID NO: 11843 - protein, 17 aa, Artificial Sequence
  Description of Artificial Sequence: Synthetic peptide
TISGSGGGTYYADSVKG

SEQ ID NO: 11844 - protein, 17 aa, Artificial Sequence
  Description of Artificial Sequence: Synthetic peptide
TISGSGGGTYYADSVKG

SEQ ID NO: 11845 - protein, 17 aa, Artificial Sequence
  Description of Artificial Sequence: Synthetic peptide
AISGSGGGTYYADSGKG

SEQ ID NO: 11846 - protein, 17 aa, Artificial Sequence
  Description of Artificial Sequence: Synthetic peptide
TISGSGGGTYYADSVKG

SEQ ID NO: 11847 - protein, 17 aa, Artificial Sequence
  Description of Artificial Sequence: Synthetic peptide
AISGSGGGTYYADSVKG

SEQ ID NO: 11848 - protein, 17 aa, Artificial Sequence
  Description of Artificial Sequence: Synthetic peptide
TISGSGGGTYYADSVKG

SEQ ID NO: 11849 - protein, 17 aa, Artificial Sequence
  Description of Artificial Sequence: Synthetic peptide
AISGSGGGTYYADSVKG

SEQ ID NO: 11850 - protein, 17 aa, Artificial Sequence
  Description of Artificial Sequence: Synthetic peptide
AISGSGGGTYYADSVKG

SEQ ID NO: 11851 - protein, 17 aa, Artificial Sequence
  Description of Artificial Sequence: Synthetic peptide
AISGSGGGTYYADSVKG

SEQ ID NO: 11852 - protein, 17 aa, Artificial Sequence
  Description of Artificial Sequence: Synthetic peptide
AISGSGGGTYYADSVKG

SEQ ID NO: 11853 - protein, 17 aa, Artificial Sequence
  Description of Artificial Sequence: Synthetic peptide
AISGSGGGTYYADSVKA

SEQ ID NO: 11854 - protein, 17 aa, Artificial Sequence
  Description of Artificial Sequence: Synthetic peptide
AISGSGGGTYYADSVKG

SEQ ID NO: 11855 - protein, 17 aa, Artificial Sequence
  Description of Artificial Sequence: Synthetic peptide
AISGSGGGTYYADSVKG

SEQ ID NO: 11856 - protein, 17 aa, Artificial Sequence
  Description of Artificial Sequence: Synthetic peptide
TISGSGGGTYYADSVKG

SEQ ID NO: 11857 - protein, 17 aa, Artificial Sequence
  Description of Artificial Sequence: Synthetic peptide
AISGSGGGTYYADSVKG

SEQ ID NO: 11858 - protein, 17 aa, Artificial Sequence
  Description of Artificial Sequence: Synthetic peptide
AISGSGGGTYYADSVKG

SEQ ID NO: 11859 - protein, 17 aa, Artificial Sequence
  Description of Artificial Sequence: Synthetic peptide
AISGSGGGTYNADSVKG

SEQ ID NO: 11860 - protein, 17 aa, Artificial Sequence
  Description of Artificial Sequence: Synthetic peptide
AISGSGGGTYYADSVKG

SEQ ID NO: 11861 - protein, 17 aa, Artificial Sequence
  Description of Artificial Sequence: Synthetic peptide
AISGSGGGTYYADSVKA

SEQ ID NO: 11862 - protein, 17 aa, Artificial Sequence
  Description of Artificial Sequence: Synthetic peptide
AISGSGGGTYNADSVKG

SEQ ID NO: 11863 - protein, 17 aa, Artificial Sequence
  Description of Artificial Sequence: Synthetic peptide
AISGSGGGTYYADSVKG

SEQ ID NO: 11864 - protein, 17 aa, Artificial Sequence
  Description of Artificial Sequence: Synthetic peptide
AISGSGGGTYYADSVKA

SEQ ID NO: 11865 - protein, 17 aa, Artificial Sequence
  Description of Artificial Sequence: Synthetic peptide
AISGSGGGTYYADSVKG

SEQ ID NO: 11866 - protein, 17 aa, Artificial Sequence
  Description of Artificial Sequence: Synthetic peptide
AISGSGGGTYYADSVKG

SEQ ID NO: 11867 - protein, 17 aa, Artificial Sequence
  Description of Artificial Sequence: Synthetic peptide
AISGSGGGTYNADSVKG

SEQ ID NO: 11868 - protein, 17 aa, Artificial Sequence
  Description of Artificial Sequence: Synthetic peptide
TISGSGGGTYYADSVKG

SEQ ID NO: 11869 - protein, 17 aa, Artificial Sequence
  Description of Artificial Sequence: Synthetic peptide
AISGSGGGTYYADSGKG

SEQ ID NO: 11870 - protein, 17 aa, Artificial Sequence
  Description of Artificial Sequence: Synthetic peptide
SISGSGGGTYYAASVKG

SEQ ID NO: 11871 - protein, 17 aa, Artificial Sequence
  Description of Artificial Sequence: Synthetic peptide
AISGSGGGTYYADSVKG

SEQ ID NO: 11872 - protein, 17 aa, Artificial Sequence
  Description of Artificial Sequence: Synthetic peptide
TISGSGGGTYYADSVKG

SEQ ID NO: 11873 - protein, 17 aa, Artificial Sequence
  Description of Artificial Sequence: Synthetic peptide
SISGSGGGTYYAASVKG

SEQ ID NO: 11874 - protein, 17 aa, Artificial Sequence
  Description of Artificial Sequence: Synthetic peptide
AISGSGGGTYNADSVKG

SEQ ID NO: 11875 - protein, 17 aa, Artificial Sequence
  Description of Artificial Sequence: Synthetic peptide
AISGSGGGTYYAASVKG

SEQ ID NO: 11876 - protein, 17 aa, Artificial Sequence
  Description of Artificial Sequence: Synthetic peptide
AISGSGGGTYYAASVKG

SEQ ID NO: 11877 - protein, 17 aa, Artificial Sequence
  Description of Artificial Sequence: Synthetic peptide
SISGSGGGTYYAASVKG

SEQ ID NO: 11878 - protein, 17 aa, Artificial Sequence
  Description of Artificial Sequence: Synthetic peptide
TISGSGGGTYYADSVKG

SEQ ID NO: 11879 - protein, 17 aa, Artificial Sequence
  Description of Artificial Sequence: Synthetic peptide
TISGSGGGTYYAASVKG

SEQ ID NO: 11880 - protein, 17 aa, Artificial Sequence
  Description of Artificial Sequence: Synthetic peptide
AISGSGGGTYNAASVKG

SEQ ID NO: 11881 - protein, 17 aa, Artificial Sequence
  Description of Artificial Sequence: Synthetic peptide
AISGSGGGTYYADSVKG

SEQ ID NO: 11882 - protein, 17 aa, Artificial Sequence
  Description of Artificial Sequence: Synthetic peptide
AISGSGGGTYYAASVKG

SEQ ID NO: 11883 - protein, 17 aa, Artificial Sequence
  Description of Artificial Sequence: Synthetic peptide
AISGSGGGTYYADSVKG

SEQ ID NO: 11884 - protein, 17 aa, Artificial Sequence
  Description of Artificial Sequence: Synthetic peptide
AISGSGGGTYYAASVKG

SEQ ID NO: 11885 - protein, 17 aa, Artificial Sequence
  Description of Artificial Sequence: Synthetic peptide
AISGSGGGTYNADSVKG

SEQ ID NO: 11886 - protein, 17 aa, Artificial Sequence
  Description of Artificial Sequence: Synthetic peptide
AISGSGGGTYNAASVKG

SEQ ID NO: 11887 - protein, 17 aa, Artificial Sequence
  Description of Artificial Sequence: Synthetic peptide
AISGSGGSTYYADSVKG

SEQ ID NO: 11888 - protein, 17 aa, Artificial Sequence
  Description of Artificial Sequence: Synthetic peptide
AISGSGGGTYYADSVKG

SEQ ID NO: 11889 - protein, 17 aa, Artificial Sequence
  Description of Artificial Sequence: Synthetic peptide
VISYDGSNKYYADSVKG

SEQ ID NO: 11890 - protein, 17 aa, Artificial Sequence
  Description of Artificial Sequence: Synthetic peptide
VISYDGSNKYYADSVKG

SEQ ID NO: 11891 - protein, 17 aa, Artificial Sequence
  Description of Artificial Sequence: Synthetic peptide
VISYDAETVKYAESVKG

SEQ ID NO: 11892 - protein, 17 aa, Artificial Sequence
  Description of Artificial Sequence: Synthetic peptide
VISYDASNKYYAESVKG

SEQ ID NO: 11893 - protein, 17 aa, Artificial Sequence
  Description of Artificial Sequence: Synthetic peptide
WISAYNGNTNYAQKLQG

SEQ ID NO: 11894 - protein, 17 aa, Artificial Sequence
  Description of Artificial Sequence: Synthetic peptide
WISGYNGDTNYAQKLQG

SEQ ID NO: 11895 - protein, 17 aa, Artificial Sequence
  Description of Artificial Sequence: Synthetic peptide
WISGYNGDTNYAQKLQG

SEQ ID NO: 11896 - protein, 17 aa, Artificial Sequence
  Description of Artificial Sequence: Synthetic peptide
YISSSGSTIYYADSVKG

SEQ ID NO: 11897 - protein, 17 aa, Artificial Sequence
  Description of Artificial Sequence: Synthetic peptide
YISKSGSTIYYADSVKG

SEQ ID NO: 11898 - protein, 17 aa, Artificial Sequence
  Description of Artificial Sequence: Synthetic peptide
YISKSSYTVTYADAVKG

SEQ ID NO: 11899 - protein, 32 aa, Artificial Sequence; identical to SEQ ID NO: 1367
  Description of Artificial Sequence: Synthetic polypeptide

SEQ ID NO: 11900 - protein, 32 aa, Artificial Sequence; identical to SEQ ID NO: 4214
  Description of Artificial Sequence: Synthetic polypeptide

SEQ ID NO: 11901 - protein, 32 aa, Artificial Sequence; identical to SEQ ID NO: 1367
  Description of Artificial Sequence: Synthetic polypeptide

SEQ ID NO: 11902 - protein, 32 aa, Artificial Sequence; identical to SEQ ID NO: 1367
  Description of Artificial Sequence: Synthetic polypeptide

SEQ ID NO: 11903 - protein, 32 aa, Artificial Sequence; identical to SEQ ID NO: 4215
  Description of Artificial Sequence: Synthetic polypeptide

SEQ ID NO: 11904 - protein, 32 aa, Artificial Sequence; identical to SEQ ID NO: 4216
  Description of Artificial Sequence: Synthetic polypeptide

SEQ ID NO: 11905 - protein, 32 aa, Artificial Sequence; identical to SEQ ID NO: 1346
  Description of Artificial Sequence: Synthetic polypeptide

SEQ ID NO: 11906 - protein, 32 aa, Artificial Sequence; identical to SEQ ID NO: 4218
  Description of Artificial Sequence: Synthetic polypeptide

SEQ ID NO: 11907 - protein, 32 aa, Artificial Sequence; identical to SEQ ID NO: 1372
  Description of Artificial Sequence: Synthetic polypeptide

SEQ ID NO: 11908 - protein, 32 aa, Artificial Sequence; identical to SEQ ID NO: 4220
  Description of Artificial Sequence: Synthetic polypeptide

SEQ ID NO: 11909 - protein, 32 aa, Artificial Sequence; identical to SEQ ID NO: 1372
  Description of Artificial Sequence: Synthetic polypeptide

SEQ ID NO: 11910 - protein, 32 aa, Artificial Sequence; identical to SEQ ID NO: 1372
  Description of Artificial Sequence: Synthetic polypeptide

SEQ ID NO: 11911 - protein, 32 aa, Artificial Sequence; identical to SEQ ID NO: 1372
  Description of Artificial Sequence: Synthetic polypeptide

SEQ ID NO: 11912 - protein, 32 aa, Artificial Sequence; identical to SEQ ID NO: 1372
  Description of Artificial Sequence: Synthetic polypeptide

SEQ ID NO: 11913 - protein, 32 aa, Artificial Sequence; identical to SEQ ID NO: 1372
  Description of Artificial Sequence: Synthetic polypeptide

SEQ ID NO: 11914 - protein, 32 aa, Artificial Sequence; identical to SEQ ID NO: 1372
  Description of Artificial Sequence: Synthetic polypeptide

SEQ ID NO: 11915 - protein, 32 aa, Artificial Sequence
  Description of Artificial Sequence: Synthetic polypeptide
GVPDRFSGSGSGTDFTLKISRVEAGDVGFYYC

SEQ ID NO: 11916 - protein, 32 aa, Artificial Sequence
  Description of Artificial Sequence: Synthetic polypeptide
GVPDRFIGSGSGTDFTLEISRVEAEDVGVYYC

SEQ ID NO: 11917 - protein, 32 aa, Artificial Sequence; identical to SEQ ID NO: 11916
  Description of Artificial Sequence: Synthetic polypeptide

SEQ ID NO: 11918 - protein, 32 aa, Artificial Sequence
  Description of Artificial Sequence: Synthetic polypeptide
GVPDRFSGSGSGTDFTLKISRVEAEDVGFYYC

SEQ ID NO: 11919 - protein, 32 aa, Artificial Sequence; identical to SEQ ID NO: 1372
  Description of Artificial Sequence: Synthetic polypeptide

SEQ ID NO: 11920 - protein, 32 aa, Artificial Sequence; identical to SEQ ID NO: 1372
  Description of Artificial Sequence: Synthetic polypeptide

SEQ ID NO: 11921 - protein, 32 aa, Artificial Sequence
  Description of Artificial Sequence: Synthetic polypeptide
GVPDRFIGSGSGTDFTLKISKVEAEDVGIYYC

SEQ ID NO: 11922 - protein, 32 aa, Artificial Sequence; identical to SEQ ID NO: 11918
  Description of Artificial Sequence: Synthetic polypeptide

SEQ ID NO: 11923 - protein, 32 aa, Artificial Sequence
  Description of Artificial Sequence: Synthetic polypeptide
GVPDRFIGSGSGTDFTLKISRVEAEDVGVYYC

SEQ ID NO: 11924 - protein, 32 aa, Artificial Sequence; identical to SEQ ID NO: 1373
  Description of Artificial Sequence: Synthetic polypeptide

SEQ ID NO: 11925 - protein, 32 aa, Artificial Sequence; identical to SEQ ID NO: 11916
  Description of Artificial Sequence: Synthetic polypeptide

SEQ ID NO: 11926 - protein, 32 aa, Artificial Sequence; identical to SEQ ID NO: 1373
  Description of Artificial Sequence: Synthetic polypeptide

SEQ ID NO: 11927 - protein, 32 aa, Artificial Sequence; identical to SEQ ID NO: 4211
  Description of Artificial Sequence: Synthetic polypeptide

SEQ ID NO: 11928 - protein, 32 aa, Artificial Sequence; identical to SEQ ID NO: 4211
  Description of Artificial Sequence: Synthetic polypeptide

SEQ ID NO: 11929 - protein, 32 aa, Artificial Sequence; identical to SEQ ID NO: 4211
  Description of Artificial Sequence: Synthetic polypeptide

SEQ ID NO: 11930 - protein, 32 aa, Artificial Sequence; identical to SEQ ID NO: 4211
  Description of Artificial Sequence: Synthetic polypeptide

SEQ ID NO: 11931 - protein, 32 aa, Artificial Sequence; identical to SEQ ID NO: 4211
  Description of Artificial Sequence: Synthetic polypeptide

SEQ ID NO: 11932 - protein, 32 aa, Artificial Sequence; identical to SEQ ID NO: 4211
  Description of Artificial Sequence: Synthetic polypeptide

SEQ ID NO: 11933 - protein, 32 aa, Artificial Sequence; identical to SEQ ID NO: 4211
  Description of Artificial Sequence: Synthetic polypeptide

SEQ ID NO: 11934 - protein, 32 aa, Artificial Sequence
  Description of Artificial Sequence: Synthetic polypeptide
GIPARFSGSGSGTDFTLTISRLEPEDFAVYYC

SEQ ID NO: 11935 - protein, 32 aa, Artificial Sequence; identical to SEQ ID NO: 4211
  Description of Artificial Sequence: Synthetic polypeptide

SEQ ID NO: 11936 - protein, 32 aa, Artificial Sequence; identical to SEQ ID NO: 1372
  Description of Artificial Sequence: Synthetic polypeptide

SEQ ID NO: 11937 - protein, 32 aa, Artificial Sequence; identical to SEQ ID NO: 1372
  Description of Artificial Sequence: Synthetic polypeptide

SEQ ID NO: 11938 - protein, 32 aa, Artificial Sequence
  Description of Artificial Sequence: Synthetic polypeptide
GVPDRFSASRSGTDFTLKISRVEAEDVGVYYC

SEQ ID NO: 11939 - protein, 32 aa, Artificial Sequence
  Description of Artificial Sequence: Synthetic polypeptide
GVPDRFSGSGSGTDFTLQISRVEAEDVGVYYC

SEQ ID NO: 11940 - protein, 32 aa, Artificial Sequence
  Description of Artificial Sequence: Synthetic polypeptide
GVPDRFSGSRSGTDFTLKISRVEAEDVGVYYC

SEQ ID NO: 11941 - protein, 32 aa, Artificial Sequence; identical to SEQ ID NO: 1372
  Description of Artificial Sequence: Synthetic polypeptide

SEQ ID NO: 11942 - protein, 32 aa, Artificial Sequence; identical to SEQ ID NO: 1372
  Description of Artificial Sequence: Synthetic polypeptide

SEQ ID NO: 11943 - protein, 32 aa, Artificial Sequence; identical to SEQ ID NO: 1372
  Description of Artificial Sequence: Synthetic polypeptide

SEQ ID NO: 11944 - protein, 32 aa, Artificial Sequence; identical to SEQ ID NO: 1372
  Description of Artificial Sequence: Synthetic polypeptide

SEQ ID NO: 11945 - protein, 32 aa, Artificial Sequence
  Description of Artificial Sequence: Synthetic polypeptide
GVPSRFSGSGSGTDFTLKISRVEAEDVGIYYC

SEQ ID NO: 11946 - protein, 32 aa, Artificial Sequence
  Description of Artificial Sequence: Synthetic polypeptide
GVPDRFSGSGSGTDFTLKISRVEAEDVGIYYC

SEQ ID NO: 11947 - protein, 32 aa, Artificial Sequence; identical to SEQ ID NO: 1372
  Description of Artificial Sequence: Synthetic polypeptide

SEQ ID NO: 11948 - protein, 32 aa, Artificial Sequence; identical to SEQ ID NO: 1346
  Description of Artificial Sequence: Synthetic polypeptide

SEQ ID NO: 11949 - protein, 32 aa, Artificial Sequence; identical to SEQ ID NO: 1346
  Description of Artificial Sequence: Synthetic polypeptide

SEQ ID NO: 11950 - protein, 32 aa, Artificial Sequence
  Description of Artificial Sequence: Synthetic polypeptide
GVPSRFSGSGSGTDFTLTISSLQPEDFAAYYC

SEQ ID NO: 11951 - protein, 32 aa, Artificial Sequence; identical to SEQ ID NO: 1372
  Description of Artificial Sequence: Synthetic polypeptide

SEQ ID NO: 11952 - protein, 32 aa, Artificial Sequence; identical to SEQ ID NO: 1372
  Description of Artificial Sequence: Synthetic polypeptide

SEQ ID NO: 11953 - protein, 32 aa, Artificial Sequence; identical to SEQ ID NO: 1372
  Description of Artificial Sequence: Synthetic polypeptide

SEQ ID NO: 11954 - protein, 32 aa, Artificial Sequence
  Description of Artificial Sequence: Synthetic polypeptide
GVPDRFSGSASGTDFTLKISRVEAEDVGVYYC

SEQ ID NO: 11955 - protein, 32 aa, Artificial Sequence
  Description of Artificial Sequence: Synthetic polypeptide
GVPDRFSGSGSGIDFTLKISRVEAEDVGVYYC

SEQ ID NO: 11956 - protein, 32 aa, Artificial Sequence
  Description of Artificial Sequence: Synthetic polypeptide
GVPDRFSGSGSGADFTLKISRVEAEDVGVYYC

SEQ ID NO: 11957 - protein, 32 aa, Artificial Sequence; identical to SEQ ID NO: 1372
  Description of Artificial Sequence: Synthetic polypeptide

SEQ ID NO: 11958 - protein, 32 aa, Artificial Sequence; identical to SEQ ID NO: 4220
  Description of Artificial Sequence: Synthetic polypeptide

SEQ ID NO: 11959 - protein, 32 aa, Artificial Sequence
  Description of Artificial Sequence: Synthetic polypeptide
GVPDRFSGSGSGTDFTLKISRVEAEDAGVYYC

SEQ ID NO: 11960 - protein, 32 aa, Artificial Sequence; identical to SEQ ID NO: 1346
  Description of Artificial Sequence: Synthetic polypeptide

SEQ ID NO: 11961 - protein, 32 aa, Artificial Sequence; identical to SEQ ID NO: 1346
  Description of Artificial Sequence: Synthetic polypeptide

SEQ ID NO: 11962 - protein, 32 aa, Artificial Sequence; identical to SEQ ID NO: 1346
  Description of Artificial Sequence: Synthetic polypeptide

SEQ ID NO: 11963 - protein, 32 aa, Artificial Sequence
  Description of Artificial Sequence: Synthetic polypeptide
GVPSRFSGSGSGTEFTLTISSLQPEDFATYYC

SEQ ID NO: 11964 - protein, 32 aa, Artificial Sequence; identical to SEQ ID NO: 1346
  Description of Artificial Sequence: Synthetic polypeptide

SEQ ID NO: 11965 - protein, 32 aa, Artificial Sequence; identical to SEQ ID NO: 1350
  Description of Artificial Sequence: Synthetic polypeptide

SEQ ID NO: 11966 - protein, 32 aa, Artificial Sequence; identical to SEQ ID NO: 1346
  Description of Artificial Sequence: Synthetic polypeptide

SEQ ID NO: 11967 - protein, 32 aa, Artificial Sequence; identical to SEQ ID NO: 1350
  Description of Artificial Sequence: Synthetic polypeptide

SEQ ID NO: 11968 - protein, 32 aa, Artificial Sequence; identical to SEQ ID NO: 1372
  Description of Artificial Sequence: Synthetic polypeptide

SEQ ID NO: 11969 - protein, 32 aa, Artificial Sequence; identical to SEQ ID NO: 1372
  Description of Artificial Sequence: Synthetic polypeptide

SEQ ID NO: 11970 - protein, 32 aa, Artificial Sequence; identical to SEQ ID NO: 1372
  Description of Artificial Sequence: Synthetic polypeptide

SEQ ID NO: 11971 - protein, 32 aa, Artificial Sequence; identical to SEQ ID NO: 1372
  Description of Artificial Sequence: Synthetic polypeptide

SEQ ID NO: 11972 - protein, 32 aa, Artificial Sequence; identical to SEQ ID NO: 1372
  Description of Artificial Sequence: Synthetic polypeptide

SEQ ID NO: 11973 - protein, 32 aa, Artificial Sequence; identical to SEQ ID NO: 1372
  Description of Artificial Sequence: Synthetic polypeptide

SEQ ID NO: 11974 - protein, 32 aa, Artificial Sequence; identical to SEQ ID NO: 1372
  Description of Artificial Sequence: Synthetic polypeptide

SEQ ID NO: 11975 - protein, 32 aa, Artificial Sequence; identical to SEQ ID NO: 1372
  Description of Artificial Sequence: Synthetic polypeptide

SEQ ID NO: 11976 - protein, 32 aa, Artificial Sequence; identical to SEQ ID NO: 11918
  Description of Artificial Sequence: Synthetic polypeptide

SEQ ID NO: 11977 - protein, 32 aa, Artificial Sequence; identical to SEQ ID NO: 1372
  Description of Artificial Sequence: Synthetic polypeptide

SEQ ID NO: 11978 - protein, 32 aa, Artificial Sequence; identical to SEQ ID NO: 11946
  Description of Artificial Sequence: Synthetic polypeptide

SEQ ID NO: 11979 - protein, 32 aa, Artificial Sequence; identical to SEQ ID NO: 11918
  Description of Artificial Sequence: Synthetic polypeptide

SEQ ID NO: 11980 - protein, 32 aa, Artificial Sequence; identical to SEQ ID NO: 4220
  Description of Artificial Sequence: Synthetic polypeptide

SEQ ID NO: 11981 - protein, 32 aa, Artificial Sequence; identical to SEQ ID NO: 1372
  Description of Artificial Sequence: Synthetic polypeptide

SEQ ID NO: 11982 - protein, 32 aa, Artificial Sequence; identical to SEQ ID NO: 1372
  Description of Artificial Sequence: Synthetic polypeptide

SEQ ID NO: 11983 - protein, 32 aa, Artificial Sequence; identical to SEQ ID NO: 1372
  Description of Artificial Sequence: Synthetic polypeptide

SEQ ID NO: 11984 - protein, 32 aa, Artificial Sequence; identical to SEQ ID NO: 1372
  Description of Artificial Sequence: Synthetic polypeptide

SEQ ID NO: 11985 - protein, 32 aa, Artificial Sequence; identical to SEQ ID NO: 1369
  Description of Artificial Sequence: Synthetic polypeptide

SEQ ID NO: 11986 - protein, 32 aa, Artificial Sequence; identical to SEQ ID NO: 1346
  Description of Artificial Sequence: Synthetic polypeptide

SEQ ID NO: 11987 - protein, 32 aa, Artificial Sequence; identical to SEQ ID NO: 1369
  Description of Artificial Sequence: Synthetic polypeptide

SEQ ID NO: 11988 - protein, 32 aa, Artificial Sequence; identical to SEQ ID NO: 1369
  Description of Artificial Sequence: Synthetic polypeptide

SEQ ID NO: 11989 - protein, 32 aa, Artificial Sequence; identical to SEQ ID NO: 1369
  Description of Artificial Sequence: Synthetic polypeptide

SEQ ID NO: 11990 - protein, 32 aa, Artificial Sequence; identical to SEQ ID NO: 1369
  Description of Artificial Sequence: Synthetic polypeptide

SEQ ID NO: 11991 - protein, 32 aa, Artificial Sequence; identical to SEQ ID NO: 1346
  Description of Artificial Sequence: Synthetic polypeptide

SEQ ID NO: 11992 - protein, 32 aa, Artificial Sequence; identical to SEQ ID NO: 1372
  Description of Artificial Sequence: Synthetic polypeptide

SEQ ID NO: 11993 - protein, 32 aa, Artificial Sequence; identical to SEQ ID NO: 1372
  Description of Artificial Sequence: Synthetic polypeptide

SEQ ID NO: 11994 - protein, 32 aa, Artificial Sequence; identical to SEQ ID NO: 1369
  Description of Artificial Sequence: Synthetic polypeptide

SEQ ID NO: 11995 - protein, 32 aa, Artificial Sequence; identical to SEQ ID NO: 1346
  Description of Artificial Sequence: Synthetic polypeptide

SEQ ID NO: 11996 - protein, 32 aa, Artificial Sequence; identical to SEQ ID NO: 1372
  Description of Artificial Sequence: Synthetic polypeptide

SEQ ID NO: 11997 - protein, 32 aa, Artificial Sequence; identical to SEQ ID NO: 1372
  Description of Artificial Sequence: Synthetic polypeptide

SEQ ID NO: 11998 - protein, 32 aa, Artificial Sequence; identical to SEQ ID NO: 1367
  Description of Artificial Sequence: Synthetic polypeptide

SEQ ID NO: 11999 - protein, 32 aa, Artificial Sequence; identical to SEQ ID NO: 1367
  Description of Artificial Sequence: Synthetic polypeptide

SEQ ID NO: 12000 - protein, 32 aa, Artificial Sequence; identical to SEQ ID NO: 1367
  Description of Artificial Sequence: Synthetic polypeptide

SEQ ID NO: 12001 - protein, 32 aa, Artificial Sequence; identical to SEQ ID NO: 1367
  Description of Artificial Sequence: Synthetic polypeptide

SEQ ID NO: 12002 - protein, 32 aa, Artificial Sequence
  Description of Artificial Sequence: Synthetic polypeptide
GVPSRFSGSGSGTDFTFTISSLQPEDIATYYC

SEQ ID NO: 12003 - protein, 32 aa, Artificial Sequence
  Description of Artificial Sequence: Synthetic polypeptide
GVPSRFSGSGSGTDFTFTISSLQPEDFATYYC

SEQ ID NO: 12004 - protein, 32 aa, Artificial Sequence; identical to SEQ ID NO: 1367
  Description of Artificial Sequence: Synthetic polypeptide

SEQ ID NO: 12005 - protein, 32 aa, Artificial Sequence; identical to SEQ ID NO: 1367
  Description of Artificial Sequence: Synthetic polypeptide

SEQ ID NO: 12006 - protein, 32 aa, Artificial Sequence; identical to SEQ ID NO: 1367
  Description of Artificial Sequence: Synthetic polypeptide

SEQ ID NO: 12007 - protein, 32 aa, Artificial Sequence; identical to SEQ ID NO: 1367
  Description of Artificial Sequence: Synthetic polypeptide

SEQ ID NO: 12008 - protein, 32 aa, Artificial Sequence; identical to SEQ ID NO: 1367
  Description of Artificial Sequence: Synthetic polypeptide

SEQ ID NO: 12009 - protein, 32 aa, Artificial Sequence; identical to SEQ ID NO: 1346
  Description of Artificial Sequence: Synthetic polypeptide

SEQ ID NO: 12010 - protein, 32 aa, Artificial Sequence; identical to SEQ ID NO: 1346
  Description of Artificial Sequence: Synthetic polypeptide

SEQ ID NO: 12011 - protein, 32 aa, Artificial Sequence; identical to SEQ ID NO: 1346
  Description of Artificial Sequence: Synthetic polypeptide

SEQ ID NO: 12012 - protein, 32 aa, Artificial Sequence; identical to SEQ ID NO: 1346
  Description of Artificial Sequence: Synthetic polypeptide

SEQ ID NO: 12013 - protein, 32 aa, Artificial Sequence; identical to SEQ ID NO: 1346
  Description of Artificial Sequence: Synthetic polypeptide

SEQ ID NO: 12014 - protein, 32 aa, Artificial Sequence; identical to SEQ ID NO: 1346
  Description of Artificial Sequence: Synthetic polypeptide

SEQ ID NO: 12015 - protein, 32 aa, Artificial Sequence; identical to SEQ ID NO: 1346
  Description of Artificial Sequence: Synthetic polypeptide

SEQ ID NO: 12016 - protein, 32 aa, Artificial Sequence; identical to SEQ ID NO: 1346
  Description of Artificial Sequence: Synthetic polypeptide

SEQ ID NO: 12017 - protein, 32 aa, Artificial Sequence; identical to SEQ ID NO: 1346
  Description of Artificial Sequence: Synthetic polypeptide

SEQ ID NO: 12018 - protein, 32 aa, Artificial Sequence; identical to SEQ ID NO: 1346
  Description of Artificial Sequence: Synthetic polypeptide

SEQ ID NO: 12019 - protein, 32 aa, Artificial Sequence; identical to SEQ ID NO: 1346
  Description of Artificial Sequence: Synthetic polypeptide

SEQ ID NO: 12020 - protein, 32 aa, Artificial Sequence; identical to SEQ ID NO: 1346
  Description of Artificial Sequence: Synthetic polypeptide

SEQ ID NO: 12021 - protein, 32 aa, Artificial Sequence; identical to SEQ ID NO: 1346
  Description of Artificial Sequence: Synthetic polypeptide

SEQ ID NO: 12022 - protein, 32 aa, Artificial Sequence; identical to SEQ ID NO: 1346
  Description of Artificial Sequence: Synthetic polypeptide

SEQ ID NO: 12023 - protein, 32 aa, Artificial Sequence; identical to SEQ ID NO: 1346
  Description of Artificial Sequence: Synthetic polypeptide

SEQ ID NO: 12024 - protein, 32 aa, Artificial Sequence; identical to SEQ ID NO: 1346
  Description of Artificial Sequence: Synthetic polypeptide

SEQ ID NO: 12025 - protein, 32 aa, Artificial Sequence; identical to SEQ ID NO: 1346
  Description of Artificial Sequence: Synthetic polypeptide

SEQ ID NO: 12026 - protein, 32 aa, Artificial Sequence; identical to SEQ ID NO: 1346
  Description of Artificial Sequence: Synthetic polypeptide

SEQ ID NO: 12027 - protein, 32 aa, Artificial Sequence; identical to SEQ ID NO: 1346
  Description of Artificial Sequence: Synthetic polypeptide

SEQ ID NO: 12028 - protein, 32 aa, Artificial Sequence; identical to SEQ ID NO: 1346
  Description of Artificial Sequence: Synthetic polypeptide

SEQ ID NO: 12029 - protein, 32 aa, Artificial Sequence
  Description of Artificial Sequence: Synthetic polypeptide
GVPSRFSGSGSGTDFTLTISSLQREDFATYYC

SEQ ID NO: 12030 - protein, 32 aa, Artificial Sequence; identical to SEQ ID NO: 1346
  Description of Artificial Sequence: Synthetic polypeptide

SEQ ID NO: 12031 - protein, 32 aa, Artificial Sequence; identical to SEQ ID NO: 1350
  Description of Artificial Sequence: Synthetic polypeptide

SEQ ID NO: 12032 - protein, 32 aa, Artificial Sequence; identical to SEQ ID NO: 1346
  Description of Artificial Sequence: Synthetic polypeptide

SEQ ID NO: 12033 - protein, 32 aa, Artificial Sequence; identical to SEQ ID NO: 1346
  Description of Artificial Sequence: Synthetic polypeptide

SEQ ID NO: 12034 - protein, 32 aa, Artificial Sequence; identical to SEQ ID NO: 1346
  Description of Artificial Sequence: Synthetic polypeptide

SEQ ID NO: 12035 - protein, 32 aa, Artificial Sequence; identical to SEQ ID NO: 1346
  Description of Artificial Sequence: Synthetic polypeptide

SEQ ID NO: 12036 - protein, 32 aa, Artificial Sequence; identical to SEQ ID NO: 1346
  Description of Artificial Sequence: Synthetic polypeptide

SEQ ID NO: 12037 - protein, 32 aa, Artificial Sequence; identical to SEQ ID NO: 1346
  Description of Artificial Sequence: Synthetic polypeptide

SEQ ID NO: 12038 - protein, 32 aa, Artificial Sequence; identical to SEQ ID NO: 1346
  Description of Artificial Sequence: Synthetic polypeptide

SEQ ID NO: 12039 - protein, 32 aa, Artificial Sequence; identical to SEQ ID NO: 1346
  Description of Artificial Sequence: Synthetic polypeptide

SEQ ID NO: 12040 - protein, 32 aa, Artificial Sequence; identical to SEQ ID NO: 1346
  Description of Artificial Sequence: Synthetic polypeptide

SEQ ID NO: 12041 - protein, 32 aa, Artificial Sequence; identical to SEQ ID NO: 1346
  Description of Artificial Sequence: Synthetic polypeptide

SEQ ID NO: 12042 - protein, 32 aa, Artificial Sequence; identical to SEQ ID NO: 1346
  Description of Artificial Sequence: Synthetic polypeptide

SEQ ID NO: 12043 - protein, 32 aa, Artificial Sequence; identical to SEQ ID NO: 1346
  Description of Artificial Sequence: Synthetic polypeptide

SEQ ID NO: 12044 - protein, 32 aa, Artificial Sequence; identical to SEQ ID NO: 1346
  Description of Artificial Sequence: Synthetic polypeptide

SEQ ID NO: 12045 - protein, 32 aa, Artificial Sequence; identical to SEQ ID NO: 1346
  Description of Artificial Sequence: Synthetic polypeptide

SEQ ID NO: 12046 - protein, 32 aa, Artificial Sequence; identical to SEQ ID NO: 1346
  Description of Artificial Sequence: Synthetic polypeptide

SEQ ID NO: 12047 - protein, 32 aa, Artificial Sequence; identical to SEQ ID NO: 1346
  Description of Artificial Sequence: Synthetic polypeptide

SEQ ID NO: 12048 - protein, 32 aa, Artificial Sequence; identical to SEQ ID NO: 4211
  Description of Artificial Sequence: Synthetic polypeptide

SEQ ID NO: 12049 - protein, 32 aa, Artificial Sequence; identical to SEQ ID NO: 1372
  Description of Artificial Sequence: Synthetic polypeptide

SEQ ID NO: 12050 - protein, 32 aa, Artificial Sequence; identical to SEQ ID NO: 1369
  Description of Artificial Sequence: Synthetic polypeptide

SEQ ID NO: 12051 - protein, 32 aa, Artificial Sequence; identical to SEQ ID NO: 1369
  Description of Artificial Sequence: Synthetic polypeptide

SEQ ID NO: 12052 - protein, 32 aa, Artificial Sequence; identical to SEQ ID NO: 1367
  Description of Artificial Sequence: Synthetic polypeptide

SEQ ID NO: 12053 - protein, 32 aa, Artificial Sequence; identical to SEQ ID NO: 1367
  Description of Artificial Sequence: Synthetic polypeptide

SEQ ID NO: 12054 - protein, 32 aa, Artificial Sequence; identical to SEQ ID NO: 1367
  Description of Artificial Sequence: Synthetic polypeptide

SEQ ID NO: 12055 - protein, 32 aa, Artificial Sequence; identical to SEQ ID NO: 1346
  Description of Artificial Sequence: Synthetic polypeptide

SEQ ID NO: 12056 - protein, 32 aa, Artificial Sequence; identical to SEQ ID NO: 1346
  Description of Artificial Sequence: Synthetic polypeptide

SEQ ID NO: 12057 - protein, 32 aa, Artificial Sequence
  Description of Artificial Sequence: Synthetic polypeptide
GVSNRFSGSKSGNTASLTISGLQAEDEADYYC

SEQ ID NO: 12058 - protein, 32 aa, Artificial Sequence; identical to SEQ ID NO: 12057
  Description of Artificial Sequence: Synthetic polypeptide

SEQ ID NO: 12059 - protein, 32 aa, Artificial Sequence
  Description of Artificial Sequence: Synthetic polypeptide
GVPDRFSGSKSGTSASLAISGLRSEDEADYYC

SEQ ID NO: 12060 - protein, 32 aa, Artificial Sequence; identical to SEQ ID NO: 12059
  Description of Artificial Sequence: Synthetic polypeptide

SEQ ID NO: 12061 - protein, 32 aa, Artificial Sequence
  Description of Artificial Sequence: Synthetic polypeptide
GISERLSASRSGNTASLTITGLQPEDEADYYC

SEQ ID NO: 12062 - protein, 32 aa, Artificial Sequence; identical to SEQ ID NO: 12061
  Description of Artificial Sequence: Synthetic polypeptide

SEQ ID NO: 12063 - protein, 32 aa, Artificial Sequence; identical to SEQ ID NO: 12061
  Description of Artificial Sequence: Synthetic polypeptide

SEQ ID NO: 12064 - protein, 32 aa, Artificial Sequence
  Description of Artificial Sequence: Synthetic polypeptide
GVPDRFSGSKSGNTASLTVSGLQAEDEADYYC

SEQ ID NO: 12065 - protein, 32 aa, Artificial Sequence; identical to SEQ ID NO: 12064
  Description of Artificial Sequence: Synthetic polypeptide

SEQ ID NO: 12066 - protein, 32 aa, Artificial Sequence; identical to SEQ ID NO: 12061
  Description of Artificial Sequence: Synthetic polypeptide

SEQ ID NO: 12067 - protein, 32 aa, Artificial Sequence; identical to SEQ ID NO: 12061
  Description of Artificial Sequence: Synthetic polypeptide

SEQ ID NO: 12068 - protein, 32 aa, Artificial Sequence; identical to SEQ ID NO: 1374
  Description of Artificial Sequence: Synthetic polypeptide

SEQ ID NO: 12069 - protein, 32 aa, Artificial Sequence; identical to SEQ ID NO: 1379
  Description of Artificial Sequence: Synthetic polypeptide

SEQ ID NO: 12070 - protein, 32 aa, Artificial Sequence
  Description of Artificial Sequence: Synthetic polypeptide
GIPERFSGSNSGNTATLTISRVEAGDEADFYC

SEQ ID NO: 12071 - protein, 32 aa, Artificial Sequence; identical to SEQ ID NO: 1374
  Description of Artificial Sequence: Synthetic polypeptide

SEQ ID NO: 12072 - protein, 32 aa, Artificial Sequence
  Description of Artificial Sequence: Synthetic polypeptide
GIPERFSGSNSGNTATLTISRVEAGDEADYHC

SEQ ID NO: 12073 - protein, 32 aa, Artificial Sequence; identical to SEQ ID NO: 12070
  Description of Artificial Sequence: Synthetic polypeptide

SEQ ID NO: 12074 - protein, 32 aa, Artificial Sequence; identical to SEQ ID NO: 1426
  Description of Artificial Sequence: Synthetic polypeptide

SEQ ID NO: 12075 - protein, 32 aa, Artificial Sequence; identical to SEQ ID NO: 1379
  Description of Artificial Sequence: Synthetic polypeptide

SEQ ID NO: 12076 - protein, 32 aa, Artificial Sequence; identical to SEQ ID NO: 1374
  Description of Artificial Sequence: Synthetic polypeptide

SEQ ID NO: 12077 - protein, 32 aa, Artificial Sequence; identical to SEQ ID NO: 1426
  Description of Artificial Sequence: Synthetic polypeptide

SEQ ID NO: 12078 - protein, 32 aa, Artificial Sequence; identical to SEQ ID NO: 12070
  Description of Artificial Sequence: Synthetic polypeptide

SEQ ID NO: 12079 - protein, 32 aa, Artificial Sequence; identical to SEQ ID NO: 1374
  Description of Artificial Sequence: Synthetic polypeptide

SEQ ID NO: 12080 - protein, 32 aa, Artificial Sequence
  Description of Artificial Sequence: Synthetic polypeptide
GIPERFSGSNFGNTATLIISRVEAGDEADFYC

SEQ ID NO: 12081 - protein, 32 aa, Artificial Sequence; identical to SEQ ID NO: 1374
  Description of Artificial Sequence: Synthetic polypeptide

SEQ ID NO: 12082 - protein, 32 aa, Artificial Sequence; identical to SEQ ID NO: 1374
  Description of Artificial Sequence: Synthetic polypeptide

SEQ ID NO: 12083 - protein, 32 aa, Artificial Sequence; identical to SEQ ID NO: 1374
  Description of Artificial Sequence: Synthetic polypeptide

SEQ ID NO: 12084 - protein, 32 aa, Artificial Sequence; identical to SEQ ID NO: 1379
  Description of Artificial Sequence: Synthetic polypeptide

SEQ ID NO: 12085 - protein, 32 aa, Artificial Sequence
  Description of Artificial Sequence: Synthetic polypeptide
GIPERFSGSNSGNTATLIISRVEAGDEADYYC

SEQ ID NO: 12086 - protein, 32 aa, Artificial Sequence; identical to SEQ ID NO: 1379
  Description of Artificial Sequence: Synthetic polypeptide

SEQ ID NO: 12087 - protein, 32 aa, Artificial Sequence; identical to SEQ ID NO: 12072
  Description of Artificial Sequence: Synthetic polypeptide

SEQ ID NO: 12088 - protein, 32 aa, Artificial Sequence; identical to SEQ ID NO: 1379
  Description of Artificial Sequence: Synthetic polypeptide

SEQ ID NO: 12089 - protein, 32 aa, Artificial Sequence; identical to SEQ ID NO: 1374
  Description of Artificial Sequence: Synthetic polypeptide

SEQ ID NO: 12090 - protein, 32 aa, Artificial Sequence; identical to SEQ ID NO: 12072
  Description of Artificial Sequence: Synthetic polypeptide

SEQ ID NO: 12091 - protein, 32 aa, Artificial Sequence; identical to SEQ ID NO: 1379
  Description of Artificial Sequence: Synthetic polypeptide

SEQ ID NO: 12092 - protein, 32 aa, Artificial Sequence; identical to SEQ ID NO: 1379
  Description of Artificial Sequence: Synthetic polypeptide

SEQ ID NO: 12093 - protein, 32 aa, Artificial Sequence; identical to SEQ ID NO: 1374
  Description of Artificial Sequence: Synthetic polypeptide

SEQ ID NO: 12094 - protein, 32 aa, Artificial Sequence; identical to SEQ ID NO: 1379
  Description of Artificial Sequence: Synthetic polypeptide

SEQ ID NO: 12095 - protein, 32 aa, Artificial Sequence; identical to SEQ ID NO: 1374
  Description of Artificial Sequence: Synthetic polypeptide

SEQ ID NO: 12096 - protein, 32 aa, Artificial Sequence; identical to SEQ ID NO: 1379
  Description of Artificial Sequence: Synthetic polypeptide

SEQ ID NO: 12097 - protein, 32 aa, Artificial Sequence; identical to SEQ ID NO: 1379
  Description of Artificial Sequence: Synthetic polypeptide

SEQ ID NO: 12098 - protein, 32 aa, Artificial Sequence; identical to SEQ ID NO: 1379
  Description of Artificial Sequence: Synthetic polypeptide

SEQ ID NO: 12099 - protein, 32 aa, Artificial Sequence; identical to SEQ ID NO: 1379
  Description of Artificial Sequence: Synthetic polypeptide

SEQ ID NO: 12100 - protein, 32 aa, Artificial Sequence; identical to SEQ ID NO: 1379
  Description of Artificial Sequence: Synthetic polypeptide

SEQ ID NO: 12101 - protein, 32 aa, Artificial Sequence; identical to SEQ ID NO: 1379
  Description of Artificial Sequence: Synthetic polypeptide

SEQ ID NO: 12102 - protein, 32 aa, Artificial Sequence; identical to SEQ ID NO: 12070
  Description of Artificial Sequence: Synthetic polypeptide

SEQ ID NO: 12103 - protein, 32 aa, Artificial Sequence; identical to SEQ ID NO: 1374
  Description of Artificial Sequence: Synthetic polypeptide

SEQ ID NO: 12104 - protein, 32 aa, Artificial Sequence; identical to SEQ ID NO: 1379
  Description of Artificial Sequence: Synthetic polypeptide

SEQ ID NO: 12105 - protein, 32 aa, Artificial Sequence; identical to SEQ ID NO: 12070
  Description of Artificial Sequence: Synthetic polypeptide

SEQ ID NO: 12106 - protein, 32 aa, Artificial Sequence
  Description of Artificial Sequence: Synthetic polypeptide
GIPERFSGSNFGNTATLIISRVAAGDEADYYC

SEQ ID NO: 12107 - protein, 32 aa, Artificial Sequence
  Description of Artificial Sequence: Synthetic polypeptide
GIPERFSGFNSGNTATLTISRVEAGDEADYYC

SEQ ID NO: 12108 - protein, 32 aa, Artificial Sequence; identical to SEQ ID NO: 1374
  Description of Artificial Sequence: Synthetic polypeptide

SEQ ID NO: 12109 - protein, 32 aa, Artificial Sequence; identical to SEQ ID NO: 1379
  Description of Artificial Sequence: Synthetic polypeptide

SEQ ID NO: 12110 - protein, 32 aa, Artificial Sequence; identical to SEQ ID NO: 1374
  Description of Artificial Sequence: Synthetic polypeptide

SEQ ID NO: 12111 - protein, 32 aa, Artificial Sequence; identical to SEQ ID NO: 12070
  Description of Artificial Sequence: Synthetic polypeptide

SEQ ID NO: 12112 - protein, 32 aa, Artificial Sequence; identical to SEQ ID NO: 1374
  Description of Artificial Sequence: Synthetic polypeptide

SEQ ID NO: 12113 - protein, 32 aa, Artificial Sequence; identical to SEQ ID NO: 1374
  Description of Artificial Sequence: Synthetic polypeptide

SEQ ID NO: 12114 - protein, 32 aa, Artificial Sequence; identical to SEQ ID NO: 12106
  Description of Artificial Sequence: Synthetic polypeptide

SEQ ID NO: 12115 - protein, 32 aa, Artificial Sequence; identical to SEQ ID NO: 1374
  Description of Artificial Sequence: Synthetic polypeptide

SEQ ID NO: 12116 - protein, 32 aa, Artificial Sequence; identical to SEQ ID NO: 12106
  Description of Artificial Sequence: Synthetic polypeptide

SEQ ID NO: 12117 - protein, 32 aa, Artificial Sequence; identical to SEQ ID NO: 1374
  Description of Artificial Sequence: Synthetic polypeptide

SEQ ID NO: 12118 - protein, 32 aa, Artificial Sequence; identical to SEQ ID NO: 1374
  Description of Artificial Sequence: Synthetic polypeptide

SEQ ID NO: 12119 - protein, 32 aa, Artificial Sequence; identical to SEQ ID NO: 1374
  Description of Artificial Sequence: Synthetic polypeptide

SEQ ID NO: 12120 - protein, 32 aa, Artificial Sequence; identical to SEQ ID NO: 1374
  Description of Artificial Sequence: Synthetic polypeptide

SEQ ID NO: 12121 - protein, 32 aa, Artificial Sequence; identical to SEQ ID NO: 12106
  Description of Artificial Sequence: Synthetic polypeptide

SEQ ID NO: 12122 - protein, 32 aa, Artificial Sequence; identical to SEQ ID NO: 12106
  Description of Artificial Sequence: Synthetic polypeptide

SEQ ID NO: 12123 - protein, 32 aa, Artificial Sequence; identical to SEQ ID NO: 1374
  Description of Artificial Sequence: Synthetic polypeptide

SEQ ID NO: 12124 - protein, 32 aa, Artificial Sequence; identical to SEQ ID NO: 1374
  Description of Artificial Sequence: Synthetic polypeptide

SEQ ID NO: 12125 - protein, 32 aa, Artificial Sequence; identical to SEQ ID NO: 1374
  Description of Artificial Sequence: Synthetic polypeptide

SEQ ID NO: 12126 - protein, 32 aa, Artificial Sequence; identical to SEQ ID NO: 1374
  Description of Artificial Sequence: Synthetic polypeptide

SEQ ID NO: 12127 - protein, 32 aa, Artificial Sequence; identical to SEQ ID NO: 1374
  Description of Artificial Sequence: Synthetic polypeptide

SEQ ID NO: 12128 - protein, 32 aa, Artificial Sequence; identical to SEQ ID NO: 1379
  Description of Artificial Sequence: Synthetic polypeptide

SEQ ID NO: 12129 - protein, 32 aa, Artificial Sequence; identical to SEQ ID NO: 1379
  Description of Artificial Sequence: Synthetic polypeptide

SEQ ID NO: 12130 - protein, 32 aa, Artificial Sequence
  Description of Artificial Sequence: Synthetic polypeptide
RVTITADTSTDTAYMELSSLRSEDTAVYYCAT

SEQ ID NO: 12131 - protein, 32 aa, Artificial Sequence; identical to SEQ ID NO: 4250
  Description of Artificial Sequence: Synthetic polypeptide

SEQ ID NO: 12132 - protein, 32 aa, Artificial Sequence; identical to SEQ ID NO: 4249
  Description of Artificial Sequence: Synthetic polypeptide

SEQ ID NO: 12133 - protein, 32 aa, Artificial Sequence; identical to SEQ ID NO: 4252
  Description of Artificial Sequence: Synthetic polypeptide

SEQ ID NO: 12134 - protein, 32 aa, Artificial Sequence; identical to SEQ ID NO: 4249
  Description of Artificial Sequence: Synthetic polypeptide

SEQ ID NO: 12135 - protein, 32 aa, Artificial Sequence; identical to SEQ ID NO: 4254
  Description of Artificial Sequence: Synthetic polypeptide

SEQ ID NO: 12136 - protein, 32 aa, Artificial Sequence; identical to SEQ ID NO: 4255
  Description of Artificial Sequence: Synthetic polypeptide

SEQ ID NO: 12137 - protein, 32 aa, Artificial Sequence; identical to SEQ ID NO: 4255
  Description of Artificial Sequence: Synthetic polypeptide

SEQ ID NO: 12138 - protein, 32 aa, Artificial Sequence; identical to SEQ ID NO: 4255
  Description of Artificial Sequence: Synthetic polypeptide

SEQ ID NO: 12139 - protein, 32 aa, Artificial Sequence; identical to SEQ ID NO: 4255
  Description of Artificial Sequence: Synthetic polypeptide

SEQ ID NO: 12140 - protein, 32 aa, Artificial Sequence; identical to SEQ ID NO: 4255
  Description of Artificial Sequence: Synthetic polypeptide

SEQ ID NO: 12141 - protein, 32 aa, Artificial Sequence; identical to SEQ ID NO: 4255
  Description of Artificial Sequence: Synthetic polypeptide

SEQ ID NO: 12142 - protein, 32 aa, Artificial Sequence; identical to SEQ ID NO: 4255
  Description of Artificial Sequence: Synthetic polypeptide

SEQ ID NO: 12143 - protein, 32 aa, Artificial Sequence; identical to SEQ ID NO: 1499
  Description of Artificial Sequence: Synthetic polypeptide

SEQ ID NO: 12144 - protein, 32 aa, Artificial Sequence
  Description of Artificial Sequence: Synthetic polypeptide
RVSISGDTSKNQFSLKLSSVTAADTAVYYCAR

SEQ ID NO: 12145 - protein, 32 aa, Artificial Sequence
  Description of Artificial Sequence: Synthetic polypeptide
RVTMSEDTAKNQFSLKLSSVTAADTAVYYCAR

SEQ ID NO: 12146 - protein, 32 aa, Artificial Sequence; identical to SEQ ID NO: 5726
  Description of Artificial Sequence: Synthetic polypeptide

SEQ ID NO: 12147 - protein, 32 aa, Artificial Sequence
  Description of Artificial Sequence: Synthetic polypeptide
RVTISEDTSRNQFSLKLSSVTAADTAVYYCTR

SEQ ID NO: 12148 - protein, 32 aa, Artificial Sequence; identical to SEQ ID NO: 5726
  Description of Artificial Sequence: Synthetic polypeptide

SEQ ID NO: 12149 - protein, 32 aa, Artificial Sequence; identical to SEQ ID NO: 12144
  Description of Artificial Sequence: Synthetic polypeptide

SEQ ID NO: 12150 - protein, 32 aa, Artificial Sequence; identical to SEQ ID NO: 5726
  Description of Artificial Sequence: Synthetic polypeptide

SEQ ID NO: 12151 - protein, 32 aa, Artificial Sequence
  Description of Artificial Sequence: Synthetic polypeptide
RVTISVDTSKNLFSLKLSSVTAADTAVYYCAR

SEQ ID NO: 12152 - protein, 32 aa, Artificial Sequence; identical to SEQ ID NO: 12145
  Description of Artificial Sequence: Synthetic polypeptide

SEQ ID NO: 12153 - protein, 32 aa, Artificial Sequence; identical to SEQ ID NO: 5726
  Description of Artificial Sequence: Synthetic polypeptide

SEQ ID NO: 12154 - protein, 32 aa, Artificial Sequence; identical to SEQ ID NO: 1427
  Description of Artificial Sequence: Synthetic polypeptide

SEQ ID NO: 12155 - protein, 32 aa, Artificial Sequence; identical to SEQ ID NO: 1427
  Description of Artificial Sequence: Synthetic polypeptide

SEQ ID NO: 12156 - protein, 32 aa, Artificial Sequence; identical to SEQ ID NO: 1427
  Description of Artificial Sequence: Synthetic polypeptide

SEQ ID NO: 12157 - protein, 32 aa, Artificial Sequence; identical to SEQ ID NO: 1427
  Description of Artificial Sequence: Synthetic polypeptide

SEQ ID NO: 12158 - protein, 32 aa, Artificial Sequence; identical to SEQ ID NO: 1427
  Description of Artificial Sequence: Synthetic polypeptide

SEQ ID NO: 12159 - protein, 32 aa, Artificial Sequence; identical to SEQ ID NO: 1427
  Description of Artificial Sequence: Synthetic polypeptide

SEQ ID NO: 12160 - protein, 32 aa, Artificial Sequence; identical to SEQ ID NO: 1501
  Description of Artificial Sequence: Synthetic polypeptide

SEQ ID NO: 12161 - protein, 32 aa, Artificial Sequence; identical to SEQ ID NO: 1501
  Description of Artificial Sequence: Synthetic polypeptide

SEQ ID NO: 12162 - protein, 32 aa, Artificial Sequence
  Description of Artificial Sequence: Synthetic polypeptide
RFTISRDNSKNTLFLQMNSLRTEDTAVYYCAR

SEQ ID NO: 12163 - protein, 32 aa, Artificial Sequence; identical to SEQ ID NO: 1499
  Description of Artificial Sequence: Synthetic polypeptide

SEQ ID NO: 12164 - protein, 32 aa, Artificial Sequence; identical to SEQ ID NO: 1499
  Description of Artificial Sequence: Synthetic polypeptide

SEQ ID NO: 12165 - protein, 32 aa, Artificial Sequence; identical to SEQ ID NO: 1499
  Description of Artificial Sequence: Synthetic polypeptide

SEQ ID NO: 12166 - protein, 32 aa, Artificial Sequence; identical to SEQ ID NO: 5726
  Description of Artificial Sequence: Synthetic polypeptide

SEQ ID NO: 12167 - protein, 32 aa, Artificial Sequence; identical to SEQ ID NO: 1499
  Description of Artificial Sequence: Synthetic polypeptide

SEQ ID NO: 12168 - protein, 32 aa, Artificial Sequence; identical to SEQ ID NO: 1499
  Description of Artificial Sequence: Synthetic polypeptide

SEQ ID NO: 12169 - protein, 32 aa, Artificial Sequence
  Description of Artificial Sequence: Synthetic polypeptide
RVTISVDPSKNQFSLKLSSVTAADTAVYYCAR

SEQ ID NO: 12170 - protein, 32 aa, Artificial Sequence; identical to SEQ ID NO: 1499
  Description of Artificial Sequence: Synthetic polypeptide

SEQ ID NO: 12171 - protein, 32 aa, Artificial Sequence; identical to SEQ ID NO: 1499
  Description of Artificial Sequence: Synthetic polypeptide

SEQ ID NO: 12172 - protein, 32 aa, Artificial Sequence; identical to SEQ ID NO: 1499
  Description of Artificial Sequence: Synthetic polypeptide

SEQ ID NO: 12173 - protein, 32 aa, Artificial Sequence; identical to SEQ ID NO: 1427
  Description of Artificial Sequence: Synthetic polypeptide

SEQ ID NO: 12174 - protein, 32 aa, Artificial Sequence; identical to SEQ ID NO: 1427
  Description of Artificial Sequence: Synthetic polypeptide

SEQ ID NO: 12175 - protein, 32 aa, Artificial Sequence
  Description of Artificial Sequence: Synthetic polypeptide
RFTISRDNSKNTLNLQMNSLRAEDTAVYYCAK

SEQ ID NO: 12176 - protein, 32 aa, Artificial Sequence; identical to SEQ ID NO: 1427
  Description of Artificial Sequence: Synthetic polypeptide

SEQ ID NO: 12177 - protein, 32 aa, Artificial Sequence; identical to SEQ ID NO: 1427
  Description of Artificial Sequence: Synthetic polypeptide

SEQ ID NO: 12178 - protein, 32 aa, Artificial Sequence; identical to SEQ ID NO: 1427
  Description of Artificial Sequence: Synthetic polypeptide

SEQ ID NO: 12179 - protein, 32 aa, Artificial Sequence; identical to SEQ ID NO: 1427
  Description of Artificial Sequence: Synthetic polypeptide

SEQ ID NO: 12180 - protein, 32 aa, Artificial Sequence; identical to SEQ ID NO: 1427
  Description of Artificial Sequence: Synthetic polypeptide

SEQ ID NO: 12181 - protein, 32 aa, Artificial Sequence; identical to SEQ ID NO: 1427
  Description of Artificial Sequence: Synthetic polypeptide

SEQ ID NO: 12182 - protein, 32 aa, Artificial Sequence; identical to SEQ ID NO: 1427
  Description of Artificial Sequence: Synthetic polypeptide

SEQ ID NO: 12183 - protein, 32 aa, Artificial Sequence
  Description of Artificial Sequence: Synthetic polypeptide
RFTISRDNSKNTLYLQMNSLRAEDTAVYFCAK

SEQ ID NO: 12184 - protein, 32 aa, Artificial Sequence; identical to SEQ ID NO: 12183
  Description of Artificial Sequence: Synthetic polypeptide

SEQ ID NO: 12185 - protein, 32 aa, Artificial Sequence; identical to SEQ ID NO: 1427
  Description of Artificial Sequence: Synthetic polypeptide

SEQ ID NO: 12186 - protein, 32 aa, Artificial Sequence; identical to SEQ ID NO: 1499
  Description of Artificial Sequence: Synthetic polypeptide

SEQ ID NO: 12187 - protein, 32 aa, Artificial Sequence; identical to SEQ ID NO: 1499
  Description of Artificial Sequence: Synthetic polypeptide

SEQ ID NO: 12188 - protein, 32 aa, Artificial Sequence
  Description of Artificial Sequence: Synthetic polypeptide
RVTLSVDSSKNQFSLKLSSVTAADTAVYYCAR

SEQ ID NO: 12189 - protein, 32 aa, Artificial Sequence
  Description of Artificial Sequence: Synthetic polypeptide
RVTISVDTSKNQFSLNLTSVTAADTAVYYCAR

SEQ ID NO: 12190 - protein, 32 aa, Artificial Sequence; identical to SEQ ID NO: 12189
  Description of Artificial Sequence: Synthetic polypeptide

SEQ ID NO: 12191 - protein, 32 aa, Artificial Sequence
  Description of Artificial Sequence: Synthetic polypeptide
RATISVDTSKDQFSLKLSSVTAADTAVYYCAR

SEQ ID NO: 12192 - protein, 32 aa, Artificial Sequence; identical to SEQ ID NO: 12191
  Description of Artificial Sequence: Synthetic polypeptide

SEQ ID NO: 12193 - protein, 32 aa, Artificial Sequence; identical to SEQ ID NO: 12191
  Description of Artificial Sequence: Synthetic polypeptide

SEQ ID NO: 12194 - protein, 32 aa, Artificial Sequence
  Description of Artificial Sequence: Synthetic polypeptide
RVTISVDTSKNQFSLKLTSVTAADTAVYYCAR

SEQ ID NO: 12195 - protein, 32 aa, Artificial Sequence; identical to SEQ ID NO: 12189
  Description of Artificial Sequence: Synthetic polypeptide

SEQ ID NO: 12196 - protein, 32 aa, Artificial Sequence; identical to SEQ ID NO: 12191
  Description of Artificial Sequence: Synthetic polypeptide

SEQ ID NO: 12197 - protein, 32 aa, Artificial Sequence; identical to SEQ ID NO: 12191
  Description of Artificial Sequence: Synthetic polypeptide

SEQ ID NO: 12198 - protein, 32 aa, Artificial Sequence
  Description of Artificial Sequence: Synthetic polypeptide
RVTMSVDSSKNQFSLKLTSVTAADTAVYYCAR

SEQ ID NO: 12199 - protein, 32 aa, Artificial Sequence
  Description of Artificial Sequence: Synthetic polypeptide
RATISVDTSKNQFSLKLSSVTAADTAVYYCAR

SEQ ID NO: 12200 - protein, 32 aa, Artificial Sequence; identical to SEQ ID NO: 12189
  Description of Artificial Sequence: Synthetic polypeptide

SEQ ID NO: 12201 - protein, 32 aa, Artificial Sequence; identical to SEQ ID NO: 12189
  Description of Artificial Sequence: Synthetic polypeptide

SEQ ID NO: 12202 - protein, 32 aa, Artificial Sequence; identical to SEQ ID NO: 12189
  Description of Artificial Sequence: Synthetic polypeptide

SEQ ID NO: 12203 - protein, 32 aa, Artificial Sequence; identical to SEQ ID NO: 12189
  Description of Artificial Sequence: Synthetic polypeptide

SEQ ID NO: 12204 - protein, 32 aa, Artificial Sequence; identical to SEQ ID NO: 12189
  Description of Artificial Sequence: Synthetic polypeptide

SEQ ID NO: 12205 - protein, 32 aa, Artificial Sequence; identical to SEQ ID NO: 1427
  Description of Artificial Sequence: Synthetic polypeptide

SEQ ID NO: 12206 - protein, 32 aa, Artificial Sequence; identical to SEQ ID NO: 5703
  Description of Artificial Sequence: Synthetic polypeptide

SEQ ID NO: 12207 - protein, 32 aa, Artificial Sequence; identical to SEQ ID NO: 1501
  Description of Artificial Sequence: Synthetic polypeptide

SEQ ID NO: 12208 - protein, 32 aa, Artificial Sequence; identical to SEQ ID NO: 1501
  Description of Artificial Sequence: Synthetic polypeptide

SEQ ID NO: 12209 - protein, 32 aa, Artificial Sequence; identical to SEQ ID NO: 1501
  Description of Artificial Sequence: Synthetic polypeptide

SEQ ID NO: 12210 - protein, 32 aa, Artificial Sequence; identical to SEQ ID NO: 4255
  Description of Artificial Sequence: Synthetic polypeptide

SEQ ID NO: 12211 - protein, 32 aa, Artificial Sequence
  Description of Artificial Sequence: Synthetic polypeptide
RVTMTRNTSISTAYMELSSLRSEDTAVYYCVR

SEQ ID NO: 12212 - protein, 32 aa, Artificial Sequence; identical to SEQ ID NO: 4255
  Description of Artificial Sequence: Synthetic polypeptide

SEQ ID NO: 12213 - protein, 32 aa, Artificial Sequence
  Description of Artificial Sequence: Synthetic polypeptide
RVTMTRNTSISTAYMELRSLRSEDTAVYYCAR

SEQ ID NO: 12214 - protein, 32 aa, Artificial Sequence
  Description of Artificial Sequence: Synthetic polypeptide
RVTMTRNTSIGTAYMELSSLRSEDTAVYYCVR

SEQ ID NO: 12215 - protein, 32 aa, Artificial Sequence
  Description of Artificial Sequence: Synthetic polypeptide
RVTMTRNTSISTAYMELSSLRSDDTAVYYCVR

SEQ ID NO: 12216 - protein, 32 aa, Artificial Sequence; identical to SEQ ID NO: 1504
  Description of Artificial Sequence: Synthetic polypeptide

SEQ ID NO: 12217 - protein, 32 aa, Artificial Sequence
  Description of Artificial Sequence: Synthetic polypeptide
RFTISRDNAKNSLYLQMNSLRAEDTAVYYCVR

SEQ ID NO: 12218 - protein, 32 aa, Artificial Sequence; identical to SEQ ID NO: 1501
  Description of Artificial Sequence: Synthetic polypeptide

SEQ ID NO: 12219 - protein, 32 aa, Artificial Sequence; identical to SEQ ID NO: 1501
  Description of Artificial Sequence: Synthetic polypeptide

SEQ ID NO: 12220 - protein, 32 aa, Artificial Sequence; identical to SEQ ID NO: 1501
  Description of Artificial Sequence: Synthetic polypeptide

SEQ ID NO: 12221 - protein, 32 aa, Artificial Sequence; identical to SEQ ID NO: 1499
  Description of Artificial Sequence: Synthetic polypeptide

SEQ ID NO: 12222 - protein, 32 aa, Artificial Sequence; identical to SEQ ID NO: 1499
  Description of Artificial Sequence: Synthetic polypeptide

SEQ ID NO: 12223 - protein, 32 aa, Artificial Sequence; identical to SEQ ID NO: 1499
  Description of Artificial Sequence: Synthetic polypeptide

SEQ ID NO: 12224 - protein, 32 aa, Artificial Sequence; identical to SEQ ID NO: 1499
  Description of Artificial Sequence: Synthetic polypeptide

SEQ ID NO: 12225 - protein, 32 aa, Artificial Sequence; identical to SEQ ID NO: 1499
  Description of Artificial Sequence: Synthetic polypeptide

SEQ ID NO: 12226 - protein, 32 aa, Artificial Sequence; identical to SEQ ID NO: 5722
  Description of Artificial Sequence: Synthetic polypeptide

SEQ ID NO: 12227 - protein, 32 aa, Artificial Sequence; identical to SEQ ID NO: 5722
  Description of Artificial Sequence: Synthetic polypeptide

SEQ ID NO: 12228 - protein, 32 aa, Artificial Sequence; identical to SEQ ID NO: 1499
  Description of Artificial Sequence: Synthetic polypeptide

SEQ ID NO: 12229 - protein, 32 aa, Artificial Sequence
  Description of Artificial Sequence: Synthetic polypeptide
RVTISVDTSKNQFSLKLSSVTAADTAVYYCAT

SEQ ID NO: 12230 - protein, 32 aa, Artificial Sequence; identical to SEQ ID NO: 1478
  Description of Artificial Sequence: Synthetic polypeptide

SEQ ID NO: 12231 - protein, 32 aa, Artificial Sequence
  Description of Artificial Sequence: Synthetic polypeptide
RLTITKDTSKNQVVLTMTNMDPVDTATYYCVY

SEQ ID NO: 12232 - protein, 32 aa, Artificial Sequence
  Description of Artificial Sequence: Synthetic polypeptide
RLTITKDTSKNQVVLTMTNMDPVDTATYYCAR

SEQ ID NO: 12233 - protein, 32 aa, Artificial Sequence; identical to SEQ ID NO: 1479
  Description of Artificial Sequence: Synthetic polypeptide

SEQ ID NO: 12234 - protein, 32 aa, Artificial Sequence; identical to SEQ ID NO: 1427
  Description of Artificial Sequence: Synthetic polypeptide

SEQ ID NO: 12235 - protein, 32 aa, Artificial Sequence; identical to SEQ ID NO: 1427
  Description of Artificial Sequence: Synthetic polypeptide

SEQ ID NO: 12236 - protein, 32 aa, Artificial Sequence; identical to SEQ ID NO: 1499
  Description of Artificial Sequence: Synthetic polypeptide

SEQ ID NO: 12237 - protein, 32 aa, Artificial Sequence
  Description of Artificial Sequence: Synthetic polypeptide
RVTMSVDTSKNQFSLKLSSVTAADTAVYYCAT

SEQ ID NO: 12238 - protein, 32 aa, Artificial Sequence; identical to SEQ ID NO: 1490
  Description of Artificial Sequence: Synthetic polypeptide

SEQ ID NO: 12239 - protein, 32 aa, Artificial Sequence; identical to SEQ ID NO: 1479
  Description of Artificial Sequence: Synthetic polypeptide

SEQ ID NO: 12240 - protein, 32 aa, Artificial Sequence; identical to SEQ ID NO: 1479
  Description of Artificial Sequence: Synthetic polypeptide

SEQ ID NO: 12241 - protein, 32 aa, Artificial Sequence; identical to SEQ ID NO: 1479
  Description of Artificial Sequence: Synthetic polypeptide

SEQ ID NO: 12242 - protein, 32 aa, Artificial Sequence; identical to SEQ ID NO: 1479
  Description of Artificial Sequence: Synthetic polypeptide

SEQ ID NO: 12243 - protein, 32 aa, Artificial Sequence; identical to SEQ ID NO: 1479
  Description of Artificial Sequence: Synthetic polypeptide

SEQ ID NO: 12244 - protein, 32 aa, Artificial Sequence; identical to SEQ ID NO: 1479
  Description of Artificial Sequence: Synthetic polypeptide

SEQ ID NO: 12245 - protein, 32 aa, Artificial Sequence; identical to SEQ ID NO: 1479
  Description of Artificial Sequence: Synthetic polypeptide

SEQ ID NO: 12246 - protein, 32 aa, Artificial Sequence; identical to SEQ ID NO: 1479
  Description of Artificial Sequence: Synthetic polypeptide

SEQ ID NO: 12247 - protein, 32 aa, Artificial Sequence; identical to SEQ ID NO: 1479
  Description of Artificial Sequence: Synthetic polypeptide

SEQ ID NO: 12248 - protein, 32 aa, Artificial Sequence; identical to SEQ ID NO: 1479
  Description of Artificial Sequence: Synthetic polypeptide

SEQ ID NO: 12249 - protein, 32 aa, Artificial Sequence; identical to SEQ ID NO: 1427
  Description of Artificial Sequence: Synthetic polypeptide

SEQ ID NO: 12250 - protein, 32 aa, Artificial Sequence; identical to SEQ ID NO: 1427
  Description of Artificial Sequence: Synthetic polypeptide

SEQ ID NO: 12251 - protein, 32 aa, Artificial Sequence; identical to SEQ ID NO: 1427
  Description of Artificial Sequence: Synthetic polypeptide

SEQ ID NO: 12252 - protein, 32 aa, Artificial Sequence; identical to SEQ ID NO: 1499
  Description of Artificial Sequence: Synthetic polypeptide

SEQ ID NO: 12253 - protein, 32 aa, Artificial Sequence
  Description of Artificial Sequence: Synthetic polypeptide
RATISVDTSKDQFSLKLTSLTAADTAVYYCAR

SEQ ID NO: 12254 - protein, 32 aa, Artificial Sequence; identical to SEQ ID NO: 12189
  Description of Artificial Sequence: Synthetic polypeptide

SEQ ID NO: 12255 - protein, 32 aa, Artificial Sequence; identical to SEQ ID NO: 12189
  Description of Artificial Sequence: Synthetic polypeptide

SEQ ID NO: 12256 - protein, 32 aa, Artificial Sequence; identical to SEQ ID NO: 1507
  Description of Artificial Sequence: Synthetic polypeptide

SEQ ID NO: 12257 - protein, 32 aa, Artificial Sequence; identical to SEQ ID NO: 12189
  Description of Artificial Sequence: Synthetic polypeptide

SEQ ID NO: 12258 - protein, 32 aa, Artificial Sequence; identical to SEQ ID NO: 1507
  Description of Artificial Sequence: Synthetic polypeptide

SEQ ID NO: 12259 - protein, 32 aa, Artificial Sequence; identical to SEQ ID NO: 1480
  Description of Artificial Sequence: Synthetic polypeptide

SEQ ID NO: 12260 - protein, 32 aa, Artificial Sequence; identical to SEQ ID NO: 1481
  Description of Artificial Sequence: Synthetic polypeptide

SEQ ID NO: 12261 - protein, 32 aa, Artificial Sequence; identical to SEQ ID NO: 1481
  Description of Artificial Sequence: Synthetic polypeptide

SEQ ID NO: 12262 - protein, 32 aa, Artificial Sequence; identical to SEQ ID NO: 1481
  Description of Artificial Sequence: Synthetic polypeptide

SEQ ID NO: 12263 - protein, 32 aa, Artificial Sequence; identical to SEQ ID NO: 1481
  Description of Artificial Sequence: Synthetic polypeptide

SEQ ID NO: 12264 - protein, 32 aa, Artificial Sequence; identical to SEQ ID NO: 1481
  Description of Artificial Sequence: Synthetic polypeptide

SEQ ID NO: 12265 - protein, 32 aa, Artificial Sequence; identical to SEQ ID NO: 1481
  Description of Artificial Sequence: Synthetic polypeptide

SEQ ID NO: 12266 - protein, 32 aa, Artificial Sequence; identical to SEQ ID NO: 1480
  Description of Artificial Sequence: Synthetic polypeptide

SEQ ID NO: 12267 - protein, 32 aa, Artificial Sequence; identical to SEQ ID NO: 1480
  Description of Artificial Sequence: Synthetic polypeptide

SEQ ID NO: 12268 - protein, 32 aa, Artificial Sequence; identical to SEQ ID NO: 1481
  Description of Artificial Sequence: Synthetic polypeptide

SEQ ID NO: 12269 - protein, 32 aa, Artificial Sequence; identical to SEQ ID NO: 1481
  Description of Artificial Sequence: Synthetic polypeptide

SEQ ID NO: 12270 - protein, 32 aa, Artificial Sequence; identical to SEQ ID NO: 1481
  Description of Artificial Sequence: Synthetic polypeptide

SEQ ID NO: 12271 - protein, 32 aa, Artificial Sequence; identical to SEQ ID NO: 1481
  Description of Artificial Sequence: Synthetic polypeptide

SEQ ID NO: 12272 - protein, 32 aa, Artificial Sequence; identical to SEQ ID NO: 1481
  Description of Artificial Sequence: Synthetic polypeptide

SEQ ID NO: 12273 - protein, 32 aa, Artificial Sequence; identical to SEQ ID NO: 1481
  Description of Artificial Sequence: Synthetic polypeptide

SEQ ID NO: 12274 - protein, 32 aa, Artificial Sequence; identical to SEQ ID NO: 1481
  Description of Artificial Sequence: Synthetic polypeptide

SEQ ID NO: 12275 - protein, 32 aa, Artificial Sequence; identical to SEQ ID NO: 1480
  Description of Artificial Sequence: Synthetic polypeptide

SEQ ID NO: 12276 - protein, 32 aa, Artificial Sequence; identical to SEQ ID NO: 1481
  Description of Artificial Sequence: Synthetic polypeptide

SEQ ID NO: 12277 - protein, 32 aa, Artificial Sequence; identical to SEQ ID NO: 1481
  Description of Artificial Sequence: Synthetic polypeptide

SEQ ID NO: 12278 - protein, 32 aa, Artificial Sequence; identical to SEQ ID NO: 1480
  Description of Artificial Sequence: Synthetic polypeptide

SEQ ID NO: 12279 - protein, 32 aa, Artificial Sequence; identical to SEQ ID NO: 1481
  Description of Artificial Sequence: Synthetic polypeptide

SEQ ID NO: 12280 - protein, 32 aa, Artificial Sequence; identical to SEQ ID NO: 1480
  Description of Artificial Sequence: Synthetic polypeptide

SEQ ID NO: 12281 - protein, 32 aa, Artificial Sequence; identical to SEQ ID NO: 1480
  Description of Artificial Sequence: Synthetic polypeptide

SEQ ID NO: 12282 - protein, 32 aa, Artificial Sequence; identical to SEQ ID NO: 1480
  Description of Artificial Sequence: Synthetic polypeptide

SEQ ID NO: 12283 - protein, 32 aa, Artificial Sequence; identical to SEQ ID NO: 1499
  Description of Artificial Sequence: Synthetic polypeptide

SEQ ID NO: 12284 - protein, 32 aa, Artificial Sequence
  Description of Artificial Sequence: Synthetic polypeptide
RVTMSVDSSKNQFSLKLTSLTAADTAVYYCAR

SEQ ID NO: 12285 - protein, 32 aa, Artificial Sequence; identical to SEQ ID NO: 1507
  Description of Artificial Sequence: Synthetic polypeptide

SEQ ID NO: 12286 - protein, 32 aa, Artificial Sequence; identical to SEQ ID NO: 1507
  Description of Artificial Sequence: Synthetic polypeptide

SEQ ID NO: 12287 - protein, 32 aa, Artificial Sequence; identical to SEQ ID NO: 1427
  Description of Artificial Sequence: Synthetic polypeptide

SEQ ID NO: 12288 - protein, 32 aa, Artificial Sequence; identical to SEQ ID NO: 1428
  Description of Artificial Sequence: Synthetic polypeptide

SEQ ID NO: 12289 - protein, 32 aa, Artificial Sequence; identical to SEQ ID NO: 1428
  Description of Artificial Sequence: Synthetic polypeptide

SEQ ID NO: 12290 - protein, 32 aa, Artificial Sequence; identical to SEQ ID NO: 1428
  Description of Artificial Sequence: Synthetic polypeptide

SEQ ID NO: 12291 - protein, 32 aa, Artificial Sequence; identical to SEQ ID NO: 1428
  Description of Artificial Sequence: Synthetic polypeptide

SEQ ID NO: 12292 - protein, 32 aa, Artificial Sequence; identical to SEQ ID NO: 1432
  Description of Artificial Sequence: Synthetic polypeptide

SEQ ID NO: 12293 - protein, 32 aa, Artificial Sequence; identical to SEQ ID NO: 1428
  Description of Artificial Sequence: Synthetic polypeptide

SEQ ID NO: 12294 - protein, 32 aa, Artificial Sequence; identical to SEQ ID NO: 1428
  Description of Artificial Sequence: Synthetic polypeptide

SEQ ID NO: 12295 - protein, 32 aa, Artificial Sequence; identical to SEQ ID NO: 1428
  Description of Artificial Sequence: Synthetic polypeptide

SEQ ID NO: 12296 - protein, 32 aa, Artificial Sequence; identical to SEQ ID NO: 1428
  Description of Artificial Sequence: Synthetic polypeptide

SEQ ID NO: 12297 - protein, 32 aa, Artificial Sequence; identical to SEQ ID NO: 1428
  Description of Artificial Sequence: Synthetic polypeptide

SEQ ID NO: 12298 - protein, 32 aa, Artificial Sequence; identical to SEQ ID NO: 1428
  Description of Artificial Sequence: Synthetic polypeptide

SEQ ID NO: 12299 - protein, 32 aa, Artificial Sequence; identical to SEQ ID NO: 1428
  Description of Artificial Sequence: Synthetic polypeptide

SEQ ID NO: 12300 - protein, 32 aa, Artificial Sequence; identical to SEQ ID NO: 1428
  Description of Artificial Sequence: Synthetic polypeptide

SEQ ID NO: 12301 - protein, 32 aa, Artificial Sequence; identical to SEQ ID NO: 1428
  Description of Artificial Sequence: Synthetic polypeptide

SEQ ID NO: 12302 - protein, 32 aa, Artificial Sequence; identical to SEQ ID NO: 1428
  Description of Artificial Sequence: Synthetic polypeptide

SEQ ID NO: 12303 - protein, 32 aa, Artificial Sequence; identical to SEQ ID NO: 1428
  Description of Artificial Sequence: Synthetic polypeptide

SEQ ID NO: 12304 - protein, 32 aa, Artificial Sequence
  Description of Artificial Sequence: Synthetic polypeptide
RFTISRDNSKNTLYLQMNSLRAEDTAVYYCAP

SEQ ID NO: 12305 - protein, 32 aa, Artificial Sequence; identical to SEQ ID NO: 1428
  Description of Artificial Sequence: Synthetic polypeptide

SEQ ID NO: 12306 - protein, 32 aa, Artificial Sequence; identical to SEQ ID NO: 1428
  Description of Artificial Sequence: Synthetic polypeptide

SEQ ID NO: 12307 - protein, 32 aa, Artificial Sequence; identical to SEQ ID NO: 1428
  Description of Artificial Sequence: Synthetic polypeptide

SEQ ID NO: 12308 - protein, 32 aa, Artificial Sequence; identical to SEQ ID NO: 1428
  Description of Artificial Sequence: Synthetic polypeptide

SEQ ID NO: 12309 - protein, 32 aa, Artificial Sequence; identical to SEQ ID NO: 1428
  Description of Artificial Sequence: Synthetic polypeptide

SEQ ID NO: 12310 - protein, 32 aa, Artificial Sequence; identical to SEQ ID NO: 1434
  Description of Artificial Sequence: Synthetic polypeptide

SEQ ID NO: 12311 - protein, 32 aa, Artificial Sequence; identical to SEQ ID NO: 1428
  Description of Artificial Sequence: Synthetic polypeptide

SEQ ID NO: 12312 - protein, 32 aa, Artificial Sequence; identical to SEQ ID NO: 1428
  Description of Artificial Sequence: Synthetic polypeptide

SEQ ID NO: 12313 - protein, 32 aa, Artificial Sequence; identical to SEQ ID NO: 1428
  Description of Artificial Sequence: Synthetic polypeptide

SEQ ID NO: 12314 - protein, 32 aa, Artificial Sequence; identical to SEQ ID NO: 1428
  Description of Artificial Sequence: Synthetic polypeptide

SEQ ID NO: 12315 - protein, 32 aa, Artificial Sequence; identical to SEQ ID NO: 1428
  Description of Artificial Sequence: Synthetic polypeptide

SEQ ID NO: 12316 - protein, 32 aa, Artificial Sequence; identical to SEQ ID NO: 1434
  Description of Artificial Sequence: Synthetic polypeptide

SEQ ID NO: 12317 - protein, 32 aa, Artificial Sequence; identical to SEQ ID NO: 1432
  Description of Artificial Sequence: Synthetic polypeptide

SEQ ID NO: 12318 - protein, 32 aa, Artificial Sequence; identical to SEQ ID NO: 1428
  Description of Artificial Sequence: Synthetic polypeptide

SEQ ID NO: 12319 - protein, 32 aa, Artificial Sequence; identical to SEQ ID NO: 1428
  Description of Artificial Sequence: Synthetic polypeptide

SEQ ID NO: 12320 - protein, 32 aa, Artificial Sequence; identical to SEQ ID NO: 1432
  Description of Artificial Sequence: Synthetic polypeptide

SEQ ID NO: 12321 - protein, 32 aa, Artificial Sequence; identical to SEQ ID NO: 1428
  Description of Artificial Sequence: Synthetic polypeptide

SEQ ID NO: 12322 - protein, 32 aa, Artificial Sequence; identical to SEQ ID NO: 1428
  Description of Artificial Sequence: Synthetic polypeptide

SEQ ID NO: 12323 - protein, 32 aa, Artificial Sequence; identical to SEQ ID NO: 1428
  Description of Artificial Sequence: Synthetic polypeptide

SEQ ID NO: 12324 - protein, 32 aa, Artificial Sequence; identical to SEQ ID NO: 1432
  Description of Artificial Sequence: Synthetic polypeptide

SEQ ID NO: 12325 - protein, 32 aa, Artificial Sequence; identical to SEQ ID NO: 1432
  Description of Artificial Sequence: Synthetic polypeptide

SEQ ID NO: 12326 - protein, 32 aa, Artificial Sequence; identical to SEQ ID NO: 1428
  Description of Artificial Sequence: Synthetic polypeptide

SEQ ID NO: 12327 - protein, 32 aa, Artificial Sequence; identical to SEQ ID NO: 1428
  Description of Artificial Sequence: Synthetic polypeptide

SEQ ID NO: 12328 - protein, 32 aa, Artificial Sequence; identical to SEQ ID NO: 1428
  Description of Artificial Sequence: Synthetic polypeptide

SEQ ID NO: 12329 - protein, 32 aa, Artificial Sequence; identical to SEQ ID NO: 1434
  Description of Artificial Sequence: Synthetic polypeptide

SEQ ID NO: 12330 - protein, 32 aa, Artificial Sequence; identical to SEQ ID NO: 1428
  Description of Artificial Sequence: Synthetic polypeptide

SEQ ID NO: 12331 - protein, 32 aa, Artificial Sequence; identical to SEQ ID NO: 1428
  Description of Artificial Sequence: Synthetic polypeptide

SEQ ID NO: 12332 - protein, 32 aa, Artificial Sequence; identical to SEQ ID NO: 1432
  Description of Artificial Sequence: Synthetic polypeptide

SEQ ID NO: 12333 - protein, 32 aa, Artificial Sequence
  Description of Artificial Sequence: Synthetic polypeptide
RFTISRDNSKNTLYLQMSSLRAEDTAVYYCVT

SEQ ID NO: 12334 - protein, 32 aa, Artificial Sequence; identical to SEQ ID NO: 1434
  Description of Artificial Sequence: Synthetic polypeptide

SEQ ID NO: 12335 - protein, 32 aa, Artificial Sequence; identical to SEQ ID NO: 1428
  Description of Artificial Sequence: Synthetic polypeptide

SEQ ID NO: 12336 - protein, 32 aa, Artificial Sequence; identical to SEQ ID NO: 1428
  Description of Artificial Sequence: Synthetic polypeptide

SEQ ID NO: 12337 - protein, 32 aa, Artificial Sequence; identical to SEQ ID NO: 1428
  Description of Artificial Sequence: Synthetic polypeptide

SEQ ID NO: 12338 - protein, 32 aa, Artificial Sequence; identical to SEQ ID NO: 1432
  Description of Artificial Sequence: Synthetic polypeptide

SEQ ID NO: 12339 - protein, 32 aa, Artificial Sequence; identical to SEQ ID NO: 12333
  Description of Artificial Sequence: Synthetic polypeptide

SEQ ID NO: 12340 - protein, 32 aa, Artificial Sequence; identical to SEQ ID NO: 12333
  Description of Artificial Sequence: Synthetic polypeptide

SEQ ID NO: 12341 - protein, 32 aa, Artificial Sequence; identical to SEQ ID NO: 1434
  Description of Artificial Sequence: Synthetic polypeptide

SEQ ID NO: 12342 - protein, 32 aa, Artificial Sequence; identical to SEQ ID NO: 1434
  Description of Artificial Sequence: Synthetic polypeptide

SEQ ID NO: 12343 - protein, 32 aa, Artificial Sequence; identical to SEQ ID NO: 1428
  Description of Artificial Sequence: Synthetic polypeptide

SEQ ID NO: 12344 - protein, 32 aa, Artificial Sequence; identical to SEQ ID NO: 1428
  Description of Artificial Sequence: Synthetic polypeptide

SEQ ID NO: 12345 - protein, 32 aa, Artificial Sequence; identical to SEQ ID NO: 1427
  Description of Artificial Sequence: Synthetic polypeptide

SEQ ID NO: 12346 - protein, 32 aa, Artificial Sequence; identical to SEQ ID NO: 1428
  Description of Artificial Sequence: Synthetic polypeptide

SEQ ID NO: 12347 - protein, 32 aa, Artificial Sequence; identical to SEQ ID NO: 1501
  Description of Artificial Sequence: Synthetic polypeptide

SEQ ID NO: 12348 - protein, 32 aa, Artificial Sequence; identical to SEQ ID NO: 3386
  Description of Artificial Sequence: Synthetic polypeptide

SEQ ID NO: 12349 - protein, 32 aa, Artificial Sequence; identical to SEQ ID NO: 1501
  Description of Artificial Sequence: Synthetic polypeptide

SEQ ID NO: 12350 - protein, 32 aa, Artificial Sequence; identical to SEQ ID NO: 1501
  Description of Artificial Sequence: Synthetic polypeptide

SEQ ID NO: 12351 - protein, 32 aa, Artificial Sequence; identical to SEQ ID NO: 3361
  Description of Artificial Sequence: Synthetic polypeptide

SEQ ID NO: 12352 - protein, 32 aa, Artificial Sequence; identical to SEQ ID NO: 3362
  Description of Artificial Sequence: Synthetic polypeptide

SEQ ID NO: 12353 - protein, 32 aa, Artificial Sequence; identical to SEQ ID NO: 3362
  Description of Artificial Sequence: Synthetic polypeptide

SEQ ID NO: 12354 - protein, 32 aa, Artificial Sequence; identical to SEQ ID NO: 1504
  Description of Artificial Sequence: Synthetic polypeptide

SEQ ID NO: 12355 - protein, 32 aa, Artificial Sequence; identical to SEQ ID NO: 1505
  Description of Artificial Sequence: Synthetic polypeptide

SEQ ID NO: 12356 - protein, 32 aa, Artificial Sequence; identical to SEQ ID NO: 1505
  Description of Artificial Sequence: Synthetic polypeptide

SEQ ID NO: 12357 - protein, 9 aa, Artificial Sequence
  Description of Artificial Sequence: Synthetic peptide
QQYYSTPYT

SEQ ID NO: 12358 - protein, 9 aa, Artificial Sequence
  Description of Artificial Sequence: Synthetic peptide
QQYYSYPYT

SEQ ID NO: 12359 - protein, 9 aa, Artificial Sequence
  Description of Artificial Sequence: Synthetic peptide
QQYYSTPWT

SEQ ID NO: 12360 - protein, 9 aa, Artificial Sequence
  Description of Artificial Sequence: Synthetic peptide
QQYYSTPWT

SEQ ID NO: 12361 - protein, 9 aa, Artificial Sequence
  Description of Artificial Sequence: Synthetic peptide
HQSSSLPYT

SEQ ID NO: 12362 - protein, 9 aa, Artificial Sequence
  Description of Artificial Sequence: Synthetic peptide
HQWSSYPPT

SEQ ID NO: 12363 - protein, 9 aa, Artificial Sequence
  Description of Artificial Sequence: Synthetic peptide
LQDYNYPYT

SEQ ID NO: 12364 - protein, 9 aa, Artificial Sequence
  Description of Artificial Sequence: Synthetic peptide
QHHYGTPLT

SEQ ID NO: 12365 - protein, 9 aa, Artificial Sequence
  Description of Artificial Sequence: Synthetic peptide
MQALQTPIT

SEQ ID NO: 12366 - protein, 9 aa, Artificial Sequence
  Description of Artificial Sequence: Synthetic peptide
MQALQTPPT

SEQ ID NO: 12367 - protein, 9 aa, Artificial Sequence
  Description of Artificial Sequence: Synthetic peptide
MQALQTPIT

SEQ ID NO: 12368 - protein, 9 aa, Artificial Sequence
  Description of Artificial Sequence: Synthetic peptide
MQALQTPYT

SEQ ID NO: 12369 - protein, 9 aa, Artificial Sequence
  Description of Artificial Sequence: Synthetic peptide
MQPLQTPPT

SEQ ID NO: 12370 - protein, 9 aa, Artificial Sequence
  Description of Artificial Sequence: Synthetic peptide
MQALQTPPT

SEQ ID NO: 12371 - protein, 9 aa, Artificial Sequence
  Description of Artificial Sequence: Synthetic peptide
MQALQTPPT

SEQ ID NO: 12372 - protein, 9 aa, Artificial Sequence
  Description of Artificial Sequence: Synthetic peptide
MQVLQTPPT

SEQ ID NO: 12373 - protein, 9 aa, Artificial Sequence
  Description of Artificial Sequence: Synthetic peptide
MQALQTPRT

SEQ ID NO: 12374 - protein, 8 aa, Artificial Sequence
  Description of Artificial Sequence: Synthetic peptide
MQALQTPS

SEQ ID NO: 12375 - protein, 8 aa, Artificial Sequence
  Description of Artificial Sequence: Synthetic peptide
MQALQTPS

SEQ ID NO: 12376 - protein, 9 aa, Artificial Sequence
  Description of Artificial Sequence: Synthetic peptide
MQGLQTPRT

SEQ ID NO: 12377 - protein, 9 aa, Artificial Sequence
  Description of Artificial Sequence: Synthetic peptide
MQRIEFPWT

SEQ ID NO: 12378 - protein, 9 aa, Artificial Sequence
  Description of Artificial Sequence: Synthetic peptide
MQGTHWPRT

SEQ ID NO: 12379 - protein, 9 aa, Artificial Sequence
  Description of Artificial Sequence: Synthetic peptide
MQALQTPRT

SEQ ID NO: 12380 - protein, 9 aa, Artificial Sequence
  Description of Artificial Sequence: Synthetic peptide
MQALQTPRT

SEQ ID NO: 12381 - protein, 8 aa, Artificial Sequence
  Description of Artificial Sequence: Synthetic peptide
MQALQTPS

SEQ ID NO: 12382 - protein, 9 aa, Artificial Sequence
  Description of Artificial Sequence: Synthetic peptide
MQALQTPWT

SEQ ID NO: 12383 - protein, 8 aa, Artificial Sequence
  Description of Artificial Sequence: Synthetic peptide
MQALQTPS

SEQ ID NO: 12384 - protein, 9 aa, Artificial Sequence
  Description of Artificial Sequence: Synthetic peptide
MQALQTPWT

SEQ ID NO: 12385 - protein, 9 aa, Artificial Sequence
  Description of Artificial Sequence: Synthetic peptide
QQYGSSPFT

SEQ ID NO: 12386 - protein, 9 aa, Artificial Sequence
  Description of Artificial Sequence: Synthetic peptide
QQYGRSLFT

SEQ ID NO: 12387 - protein, 9 aa, Artificial Sequence
  Description of Artificial Sequence: Synthetic peptide
QQYGSSPFT

SEQ ID NO: 12388 - protein, 9 aa, Artificial Sequence
  Description of Artificial Sequence: Synthetic peptide
QQYGSSPLT

SEQ ID NO: 12389 - protein, 9 aa, Artificial Sequence
  Description of Artificial Sequence: Synthetic peptide
QQYGSSPLT

SEQ ID NO: 12390 - protein, 9 aa, Artificial Sequence
  Description of Artificial Sequence: Synthetic peptide
QQYGSSPLT

SEQ ID NO: 12391 - protein, 8 aa, Artificial Sequence
  Description of Artificial Sequence: Synthetic peptide
QQYGSSLT

SEQ ID NO: 12392 - protein, 9 aa, Artificial Sequence
  Description of Artificial Sequence: Synthetic peptide
QQYGSSPLT

SEQ ID NO: 12393 - protein, 9 aa, Artificial Sequence
  Description of Artificial Sequence: Synthetic peptide
QQYGTSPLT

SEQ ID NO: 12394 - protein, 9 aa, Artificial Sequence
  Description of Artificial Sequence: Synthetic peptide
MQALQTPFT

SEQ ID NO: 12395 - protein, 9 aa, Artificial Sequence
  Description of Artificial Sequence: Synthetic peptide
MQALQTPFT

SEQ ID NO: 12396 - protein, 9 aa, Artificial Sequence
  Description of Artificial Sequence: Synthetic peptide
MQALQTPFT

SEQ ID NO: 12397 - protein, 9 aa, Artificial Sequence
  Description of Artificial Sequence: Synthetic peptide
MQGTHWPFT

SEQ ID NO: 12398 - protein, 9 aa, Artificial Sequence
  Description of Artificial Sequence: Synthetic peptide
MQALQTPFT

SEQ ID NO: 12399 - protein, 9 aa, Artificial Sequence
  Description of Artificial Sequence: Synthetic peptide
MQALQTPFT

SEQ ID NO: 12400 - protein, 9 aa, Artificial Sequence
  Description of Artificial Sequence: Synthetic peptide
MQALQTPFT

SEQ ID NO: 12401 - protein, 9 aa, Artificial Sequence
  Description of Artificial Sequence: Synthetic peptide
MQALQTPFT

SEQ ID NO: 12402 - protein, 9 aa, Artificial Sequence
  Description of Artificial Sequence: Synthetic peptide
MQALQTPFT

SEQ ID NO: 12403 - protein, 9 aa, Artificial Sequence
  Description of Artificial Sequence: Synthetic peptide
MQALQTPFT

SEQ ID NO: 12404 - protein, 9 aa, Artificial Sequence
  Description of Artificial Sequence: Synthetic peptide
MQALQTPFT

SEQ ID NO: 12405 - protein, 9 aa, Artificial Sequence
  Description of Artificial Sequence: Synthetic peptide
MQGLQTPFT

SEQ ID NO: 12406 - protein, 9 aa, Artificial Sequence
  Description of Artificial Sequence: Synthetic peptide
QQANSFPWT

SEQ ID NO: 12407 - protein, 9 aa, Artificial Sequence
  Description of Artificial Sequence: Synthetic peptide
QQANSFPPT

SEQ ID NO: 12408 - protein, 9 aa, Artificial Sequence
  Description of Artificial Sequence: Synthetic peptide
QQSYSTPPT

SEQ ID NO: 12409 - protein, 9 aa, Artificial Sequence
  Description of Artificial Sequence: Synthetic peptide
MQALQTPLT

SEQ ID NO: 12410 - protein, 9 aa, Artificial Sequence
  Description of Artificial Sequence: Synthetic peptide
MQALQTPLT

SEQ ID NO: 12411 - protein, 9 aa, Artificial Sequence
  Description of Artificial Sequence: Synthetic peptide
MQGTHWPLT

SEQ ID NO: 12412 - protein, 9 aa, Artificial Sequence
  Description of Artificial Sequence: Synthetic peptide
MQGTHWPLT

SEQ ID NO: 12413 - protein, 8 aa, Artificial Sequence
  Description of Artificial Sequence: Synthetic peptide
MQALQTPH

SEQ ID NO: 12414 - protein, 9 aa, Artificial Sequence
  Description of Artificial Sequence: Synthetic peptide
MQALQTPLT

SEQ ID NO: 12415 - protein, 9 aa, Artificial Sequence
  Description of Artificial Sequence: Synthetic peptide
MQRIEFPYT

SEQ ID NO: 12416 - protein, 9 aa, Artificial Sequence
  Description of Artificial Sequence: Synthetic peptide
MQALQTPCS

SEQ ID NO: 12417 - protein, 9 aa, Artificial Sequence
  Description of Artificial Sequence: Synthetic peptide
MQSLHLPPT

SEQ ID NO: 12418 - protein, 9 aa, Artificial Sequence
  Description of Artificial Sequence: Synthetic peptide
QQSYSTPWT

SEQ ID NO: 12419 - protein, 9 aa, Artificial Sequence
  Description of Artificial Sequence: Synthetic peptide
QQSYRTPPT

SEQ ID NO: 12420 - protein, 9 aa, Artificial Sequence
  Description of Artificial Sequence: Synthetic peptide
QQSYSTPPT

SEQ ID NO: 12421 - protein, 9 aa, Artificial Sequence
  Description of Artificial Sequence: Synthetic peptide
QQSYSTPPT

SEQ ID NO: 12422 - protein, 9 aa, Artificial Sequence
  Description of Artificial Sequence: Synthetic peptide
QQSYSVPPT

SEQ ID NO: 12423 - protein, 9 aa, Artificial Sequence
  Description of Artificial Sequence: Synthetic peptide
QQSYYYPTL

SEQ ID NO: 12424 - protein, 9 aa, Artificial Sequence
  Description of Artificial Sequence: Synthetic peptide
QQSYFPVVE

SEQ ID NO: 12425 - protein, 9 aa, Artificial Sequence
  Description of Artificial Sequence: Synthetic peptide
QQSYTPPTT

SEQ ID NO: 12426 - protein, 9 aa, Artificial Sequence
  Description of Artificial Sequence: Synthetic peptide
MQRIEFPIT

SEQ ID NO: 12427 - protein, 9 aa, Artificial Sequence
  Description of Artificial Sequence: Synthetic peptide
MQALQTPIT

SEQ ID NO: 12428 - protein, 9 aa, Artificial Sequence
  Description of Artificial Sequence: Synthetic peptide
MQALQTPIT

SEQ ID NO: 12429 - protein, 9 aa, Artificial Sequence
  Description of Artificial Sequence: Synthetic peptide
MQALQTPWT

SEQ ID NO: 12430 - protein, 9 aa, Artificial Sequence
  Description of Artificial Sequence: Synthetic peptide
MQALQTPWT

SEQ ID NO: 12431 - protein, 9 aa, Artificial Sequence
  Description of Artificial Sequence: Synthetic peptide
MQSIQLPWT

SEQ ID NO: 12432 - protein, 9 aa, Artificial Sequence
  Description of Artificial Sequence: Synthetic peptide
MQALQTPPT

SEQ ID NO: 12433 - protein, 9 aa, Artificial Sequence
  Description of Artificial Sequence: Synthetic peptide
MQALQTPRT

SEQ ID NO: 12434 - protein, 9 aa, Artificial Sequence
  Description of Artificial Sequence: Synthetic peptide
MQALQTPRT

SEQ ID NO: 12435 - protein, 9 aa, Artificial Sequence
  Description of Artificial Sequence: Synthetic peptide
MQALQTPRT

SEQ ID NO: 12436 - protein, 9 aa, Artificial Sequence
  Description of Artificial Sequence: Synthetic peptide
MQALQTPRT

SEQ ID NO: 12437 - protein, 9 aa, Artificial Sequence
  Description of Artificial Sequence: Synthetic peptide
MQALQTPRT

SEQ ID NO: 12438 - protein, 9 aa, Artificial Sequence
  Description of Artificial Sequence: Synthetic peptide
MQALQTPRT

SEQ ID NO: 12439 - protein, 9 aa, Artificial Sequence
  Description of Artificial Sequence: Synthetic peptide
MQRIEFPLT

SEQ ID NO: 12440 - protein, 9 aa, Artificial Sequence
  Description of Artificial Sequence: Synthetic peptide
MQALQTPLT

SEQ ID NO: 12441 - protein, 8 aa, Artificial Sequence
  Description of Artificial Sequence: Synthetic peptide
MQALQSLT

SEQ ID NO: 12442 - protein, 9 aa, Artificial Sequence
  Description of Artificial Sequence: Synthetic peptide
MQALQTPLT

SEQ ID NO: 12443 - protein, 9 aa, Artificial Sequence
  Description of Artificial Sequence: Synthetic peptide
QKYNSAPFT

SEQ ID NO: 12444 - protein, 9 aa, Artificial Sequence
  Description of Artificial Sequence: Synthetic peptide
QQSYSTPFT

SEQ ID NO: 12445 - protein, 9 aa, Artificial Sequence
  Description of Artificial Sequence: Synthetic peptide
QKYYSAPFT

SEQ ID NO: 12446 - protein, 9 aa, Artificial Sequence
  Description of Artificial Sequence: Synthetic peptide
QKYNSAPFT

SEQ ID NO: 12447 - protein, 9 aa, Artificial Sequence
  Description of Artificial Sequence: Synthetic peptide
QKYNSAPFT

SEQ ID NO: 12448 - protein, 9 aa, Artificial Sequence
  Description of Artificial Sequence: Synthetic peptide
QKYNSAPFT

SEQ ID NO: 12449 - protein, 9 aa, Artificial Sequence
  Description of Artificial Sequence: Synthetic peptide
QKYNSAPFT

SEQ ID NO: 12450 - protein, 9 aa, Artificial Sequence
  Description of Artificial Sequence: Synthetic peptide
MQRIEFPFT

SEQ ID NO: 12451 - protein, 9 aa, Artificial Sequence
  Description of Artificial Sequence: Synthetic peptide
MQGTHWPFT

SEQ ID NO: 12452 - protein, 9 aa, Artificial Sequence
  Description of Artificial Sequence: Synthetic peptide
QKYNSAPWT

SEQ ID NO: 12453 - protein, 9 aa, Artificial Sequence
  Description of Artificial Sequence: Synthetic peptide
QQSYSTPPT

SEQ ID NO: 12454 - protein, 9 aa, Artificial Sequence
  Description of Artificial Sequence: Synthetic peptide
MQGIHLPIT

SEQ ID NO: 12455 - protein, 9 aa, Artificial Sequence
  Description of Artificial Sequence: Synthetic peptide
MQALQTPIT

SEQ ID NO: 12456 - protein, 9 aa, Artificial Sequence
  Description of Artificial Sequence: Synthetic peptide
QQYYSTPWT

SEQ ID NO: 12457 - protein, 9 aa, Artificial Sequence
  Description of Artificial Sequence: Synthetic peptide
QQYYSTPWT

SEQ ID NO: 12458 - protein, 9 aa, Artificial Sequence
  Description of Artificial Sequence: Synthetic peptide
QQYYSTPWT

SEQ ID NO: 12459 - protein, 9 aa, Artificial Sequence
  Description of Artificial Sequence: Synthetic peptide
QQYYSTPWT

SEQ ID NO: 12460 - protein, 9 aa, Artificial Sequence
  Description of Artificial Sequence: Synthetic peptide
QQYDNLPWT

SEQ ID NO: 12461 - protein, 9 aa, Artificial Sequence
  Description of Artificial Sequence: Synthetic peptide
QQSYSIPPT

SEQ ID NO: 12462 - protein, 9 aa, Artificial Sequence
  Description of Artificial Sequence: Synthetic peptide
QQYYSTPLT

SEQ ID NO: 12463 - protein, 9 aa, Artificial Sequence
  Description of Artificial Sequence: Synthetic peptide
QQYYSTPLT

SEQ ID NO: 12464 - protein, 9 aa, Artificial Sequence
  Description of Artificial Sequence: Synthetic peptide
QQYYSTPLT

SEQ ID NO: 12465 - protein, 9 aa, Artificial Sequence
  Description of Artificial Sequence: Synthetic peptide
QQYYSTPLT

SEQ ID NO: 12466 - protein, 9 aa, Artificial Sequence
  Description of Artificial Sequence: Synthetic peptide
QQYYSTPLT

SEQ ID NO: 12467 - protein, 9 aa, Artificial Sequence
  Description of Artificial Sequence: Synthetic peptide
QQSYSTPYT

SEQ ID NO: 12468 - protein, 9 aa, Artificial Sequence
  Description of Artificial Sequence: Synthetic peptide
QQSYSTPFT

SEQ ID NO: 12469 - protein, 9 aa, Artificial Sequence
  Description of Artificial Sequence: Synthetic peptide
QQSYSTPFT

SEQ ID NO: 12470 - protein, 9 aa, Artificial Sequence
  Description of Artificial Sequence: Synthetic peptide
QQTYSMPFT

SEQ ID NO: 12471 - protein, 9 aa, Artificial Sequence
  Description of Artificial Sequence: Synthetic peptide
QQSYITPFT

SEQ ID NO: 12472 - protein, 9 aa, Artificial Sequence
  Description of Artificial Sequence: Synthetic peptide
QQSYSTPFT

SEQ ID NO: 12473 - protein, 9 aa, Artificial Sequence
  Description of Artificial Sequence: Synthetic peptide
QQTYSSPFT

SEQ ID NO: 12474 - protein, 9 aa, Artificial Sequence
  Description of Artificial Sequence: Synthetic peptide
QQTYSMPFT

SEQ ID NO: 12475 - protein, 9 aa, Artificial Sequence
  Description of Artificial Sequence: Synthetic peptide
IQAYTSPFT

SEQ ID NO: 12476 - protein, 9 aa, Artificial Sequence
  Description of Artificial Sequence: Synthetic peptide
QQTYSSPFT

SEQ ID NO: 12477 - protein, 9 aa, Artificial Sequence
  Description of Artificial Sequence: Synthetic peptide
QQSYSTPLT

SEQ ID NO: 12478 - protein, 9 aa, Artificial Sequence
  Description of Artificial Sequence: Synthetic peptide
QQSYSTPLT

SEQ ID NO: 12479 - protein, 9 aa, Artificial Sequence
  Description of Artificial Sequence: Synthetic peptide
QQSYSIPLT

SEQ ID NO: 12480 - protein, 9 aa, Artificial Sequence
  Description of Artificial Sequence: Synthetic peptide
QQTYSMPFT

SEQ ID NO: 12481 - protein, 9 aa, Artificial Sequence
  Description of Artificial Sequence: Synthetic peptide
QQTYSMPFT

SEQ ID NO: 12482 - protein, 9 aa, Artificial Sequence
  Description of Artificial Sequence: Synthetic peptide
QQSYSTPFT

SEQ ID NO: 12483 - protein, 9 aa, Artificial Sequence
  Description of Artificial Sequence: Synthetic peptide
QQSYSIPFT

SEQ ID NO: 12484 - protein, 9 aa, Artificial Sequence
  Description of Artificial Sequence: Synthetic peptide
QQTYSMPFT

SEQ ID NO: 12485 - protein, 9 aa, Artificial Sequence
  Description of Artificial Sequence: Synthetic peptide
QQSYSTPFT

SEQ ID NO: 12486 - protein, 9 aa, Artificial Sequence
  Description of Artificial Sequence: Synthetic peptide
QQTYSMPFT

SEQ ID NO: 12487 - protein, 9 aa, Artificial Sequence
  Description of Artificial Sequence: Synthetic peptide
QQSYSTPFT

SEQ ID NO: 12488 - protein, 9 aa, Artificial Sequence
  Description of Artificial Sequence: Synthetic peptide
QQTYSMPFT

SEQ ID NO: 12489 - protein, 9 aa, Artificial Sequence
  Description of Artificial Sequence: Synthetic peptide
QQSYSTPFT

SEQ ID NO: 12490 - protein, 9 aa, Artificial Sequence
  Description of Artificial Sequence: Synthetic peptide
QQSYSTPFT

SEQ ID NO: 12491 - protein, 9 aa, Artificial Sequence
  Description of Artificial Sequence: Synthetic peptide
QQSYTTPFT

SEQ ID NO: 12492 - protein, 9 aa, Artificial Sequence
  Description of Artificial Sequence: Synthetic peptide
QQTYSMPFT

SEQ ID NO: 12493 - protein, 9 aa, Artificial Sequence
  Description of Artificial Sequence: Synthetic peptide
QQSYSSPFT

SEQ ID NO: 12494 - protein, 9 aa, Artificial Sequence
  Description of Artificial Sequence: Synthetic peptide
QQTYSMPFT

SEQ ID NO: 12495 - protein, 9 aa, Artificial Sequence
  Description of Artificial Sequence: Synthetic peptide
QQTYSMPFT

SEQ ID NO: 12496 - protein, 9 aa, Artificial Sequence
  Description of Artificial Sequence: Synthetic peptide
QQTYSMPFT

SEQ ID NO: 12497 - protein, 9 aa, Artificial Sequence
  Description of Artificial Sequence: Synthetic peptide
QQTYSMPFT

SEQ ID NO: 12498 - protein, 9 aa, Artificial Sequence
  Description of Artificial Sequence: Synthetic peptide
QQSYSSPFT

SEQ ID NO: 12499 - protein, 9 aa, Artificial Sequence
  Description of Artificial Sequence: Synthetic peptide
QQSYSSPFT

SEQ ID NO: 12500 - protein, 9 aa, Artificial Sequence
  Description of Artificial Sequence: Synthetic peptide
QQSYITPFT

SEQ ID NO: 12501 - protein, 9 aa, Artificial Sequence
  Description of Artificial Sequence: Synthetic peptide
QQTYSMPFT

SEQ ID NO: 12502 - protein, 9 aa, Artificial Sequence
  Description of Artificial Sequence: Synthetic peptide
QQTYSMPFT

SEQ ID NO: 12503 - protein, 9 aa, Artificial Sequence
  Description of Artificial Sequence: Synthetic peptide
QQTYSMPFT

SEQ ID NO: 12504 - protein, 9 aa, Artificial Sequence
  Description of Artificial Sequence: Synthetic peptide
QQANSFPLT

SEQ ID NO: 12505 - protein, 9 aa, Artificial Sequence
  Description of Artificial Sequence: Synthetic peptide
QQSYSTPLT

SEQ ID NO: 12506 - protein, 9 aa, Artificial Sequence
  Description of Artificial Sequence: Synthetic peptide
QQYGSSPWT

SEQ ID NO: 12507 - protein, 9 aa, Artificial Sequence
  Description of Artificial Sequence: Synthetic peptide
MQALQTPRT

SEQ ID NO: 12508 - protein, 9 aa, Artificial Sequence
  Description of Artificial Sequence: Synthetic peptide
QKYNSAPYT

SEQ ID NO: 12509 - protein, 9 aa, Artificial Sequence
  Description of Artificial Sequence: Synthetic peptide
QKYNSAPFT

SEQ ID NO: 12510 - protein, 9 aa, Artificial Sequence
  Description of Artificial Sequence: Synthetic peptide
QQYYSTPIT

SEQ ID NO: 12511 - protein, 9 aa, Artificial Sequence
  Description of Artificial Sequence: Synthetic peptide
QQFYSTPIT

SEQ ID NO: 12512 - protein, 9 aa, Artificial Sequence
  Description of Artificial Sequence: Synthetic peptide
QQFYSTPIT

SEQ ID NO: 12513 - protein, 9 aa, Artificial Sequence
  Description of Artificial Sequence: Synthetic peptide
QQSYSTPIT

SEQ ID NO: 12514 - protein, 9 aa, Artificial Sequence
  Description of Artificial Sequence: Synthetic peptide
QQSYSTPIT

SEQ ID NO: 12515 - protein, 11 aa, Artificial Sequence
  Description of Artificial Sequence: Synthetic peptide
SSYTSSSTLVV

SEQ ID NO: 12516 - protein, 10 aa, Artificial Sequence
  Description of Artificial Sequence: Synthetic peptide
SSYTSSSTLV

SEQ ID NO: 12517 - protein, 11 aa, Artificial Sequence
  Description of Artificial Sequence: Synthetic peptide
AAWDDSLSGVV

SEQ ID NO: 12518 - protein, 11 aa, Artificial Sequence
  Description of Artificial Sequence: Synthetic peptide
AAWDDSLSGVV

SEQ ID NO: 12519 - protein, 11 aa, Artificial Sequence
  Description of Artificial Sequence: Synthetic peptide
SAWDSSLSAWV

SEQ ID NO: 12520 - protein, 11 aa, Artificial Sequence
  Description of Artificial Sequence: Synthetic peptide
SAWDSSLSAWV

SEQ ID NO: 12521 - protein, 11 aa, Artificial Sequence
  Description of Artificial Sequence: Synthetic peptide
SAWDSSLSAWV

SEQ ID NO: 12522 - protein, 11 aa, Artificial Sequence
  Description of Artificial Sequence: Synthetic peptide
SSYAGSNNFVV

SEQ ID NO: 12523 - protein, 10 aa, Artificial Sequence
  Description of Artificial Sequence: Synthetic peptide
SSYAGSNNVV

SEQ ID NO: 12524 - protein, 11 aa, Artificial Sequence
  Description of Artificial Sequence: Synthetic peptide
SAWDSSLSAVV

SEQ ID NO: 12525 - protein, 11 aa, Artificial Sequence
  Description of Artificial Sequence: Synthetic peptide
SAWDSSLSAVV

SEQ ID NO: 12526 - protein, 11 aa, Artificial Sequence
  Description of Artificial Sequence: Synthetic peptide
QVWDSSSDHVV

SEQ ID NO: 12527 - protein, 11 aa, Artificial Sequence
  Description of Artificial Sequence: Synthetic peptide
QVWDSSSDHVV

SEQ ID NO: 12528 - protein, 11 aa, Artificial Sequence
  Description of Artificial Sequence: Synthetic peptide
QVWDSSSDHVV

SEQ ID NO: 12529 - protein, 11 aa, Artificial Sequence
  Description of Artificial Sequence: Synthetic peptide
QVWDSSSDHVV

SEQ ID NO: 12530 - protein, 11 aa, Artificial Sequence
  Description of Artificial Sequence: Synthetic peptide
QVWDSSSDHVV

SEQ ID NO: 12531 - protein, 11 aa, Artificial Sequence
  Description of Artificial Sequence: Synthetic peptide
QVWDSSSDHVV

SEQ ID NO: 12532 - protein, 11 aa, Artificial Sequence
  Description of Artificial Sequence: Synthetic peptide
QVWDSSSDHVV

SEQ ID NO: 12533 - protein, 11 aa, Artificial Sequence
  Description of Artificial Sequence: Synthetic peptide
QVWDSSSDHVV

SEQ ID NO: 12534 - protein, 11 aa, Artificial Sequence
  Description of Artificial Sequence: Synthetic peptide
QVWDSSSDHVV

SEQ ID NO: 12535 - protein, 11 aa, Artificial Sequence
  Description of Artificial Sequence: Synthetic peptide
QVWDSSSDHVV

SEQ ID NO: 12536 - protein, 11 aa, Artificial Sequence
  Description of Artificial Sequence: Synthetic peptide
QVWDSSSDHVV

SEQ ID NO: 12537 - protein, 11 aa, Artificial Sequence
  Description of Artificial Sequence: Synthetic peptide
QVWDSSSDHVV

SEQ ID NO: 12538 - protein, 11 aa, Artificial Sequence
  Description of Artificial Sequence: Synthetic peptide
QVWDSSSDHVV

SEQ ID NO: 12539 - protein, 11 aa, Artificial Sequence
  Description of Artificial Sequence: Synthetic peptide
QVWDSSSDHAV

SEQ ID NO: 12540 - protein, 11 aa, Artificial Sequence
  Description of Artificial Sequence: Synthetic peptide
QVWDSSSDHVV

SEQ ID NO: 12541 - protein, 11 aa, Artificial Sequence
  Description of Artificial Sequence: Synthetic peptide
QVWDSSSDHVV

SEQ ID NO: 12542 - protein, 11 aa, Artificial Sequence
  Description of Artificial Sequence: Synthetic peptide
QVWDSSSDHVV

SEQ ID NO: 12543 - protein, 11 aa, Artificial Sequence
  Description of Artificial Sequence: Synthetic peptide
QVWDSSSDHVV

SEQ ID NO: 12544 - protein, 11 aa, Artificial Sequence
  Description of Artificial Sequence: Synthetic peptide
QVWDSSSDHVV

SEQ ID NO: 12545 - protein, 11 aa, Artificial Sequence
  Description of Artificial Sequence: Synthetic peptide
QVWDSSSDHVI

SEQ ID NO: 12546 - protein, 11 aa, Artificial Sequence
  Description of Artificial Sequence: Synthetic peptide
QVWDSNSDHVV

SEQ ID NO: 12547 - protein, 11 aa, Artificial Sequence
  Description of Artificial Sequence: Synthetic peptide
QVWDSSSDHVI

SEQ ID NO: 12548 - protein, 11 aa, Artificial Sequence
  Description of Artificial Sequence: Synthetic peptide
QVWDSSSDHVV

SEQ ID NO: 12549 - protein, 11 aa, Artificial Sequence
  Description of Artificial Sequence: Synthetic peptide
QVWDSSSDHVV

SEQ ID NO: 12550 - protein, 11 aa, Artificial Sequence
  Description of Artificial Sequence: Synthetic peptide
QVWDSSSDHVV

SEQ ID NO: 12551 - protein, 11 aa, Artificial Sequence
  Description of Artificial Sequence: Synthetic peptide
QVWDSSSDHVV

SEQ ID NO: 12552 - protein, 11 aa, Artificial Sequence
  Description of Artificial Sequence: Synthetic peptide
QVWDSSSDHVV

SEQ ID NO: 12553 - protein, 11 aa, Artificial Sequence
  Description of Artificial Sequence: Synthetic peptide
QVWDSSSDHVM

SEQ ID NO: 12554 - protein, 11 aa, Artificial Sequence
  Description of Artificial Sequence: Synthetic peptide
QVWDSSSDHVV

SEQ ID NO: 12555 - protein, 11 aa, Artificial Sequence
  Description of Artificial Sequence: Synthetic peptide
QVWDSSSDHVV

SEQ ID NO: 12556 - protein, 11 aa, Artificial Sequence
  Description of Artificial Sequence: Synthetic peptide
QVWDSSSDHVV

SEQ ID NO: 12557 - protein, 11 aa, Artificial Sequence
  Description of Artificial Sequence: Synthetic peptide
QVWDSSSDHVV

SEQ ID NO: 12558 - protein, 11 aa, Artificial Sequence
  Description of Artificial Sequence: Synthetic peptide
QVWDSSSDHVV

SEQ ID NO: 12559 - protein, 11 aa, Artificial Sequence
  Description of Artificial Sequence: Synthetic peptide
QVWDSSSDHVV

SEQ ID NO: 12560 - protein, 11 aa, Artificial Sequence
  Description of Artificial Sequence: Synthetic peptide
QVWDSSSDHVV

SEQ ID NO: 12561 - protein, 12 aa, Artificial Sequence
  Description of Artificial Sequence: Synthetic peptide
QVWDSSSDHHVV

SEQ ID NO: 12562 - protein, 11 aa, Artificial Sequence
  Description of Artificial Sequence: Synthetic peptide
QVWDSSSDHVV

SEQ ID NO: 12563 - protein, 11 aa, Artificial Sequence
  Description of Artificial Sequence: Synthetic peptide
QVWDSSSDHVV

SEQ ID NO: 12564 - protein, 11 aa, Artificial Sequence
  Description of Artificial Sequence: Synthetic peptide
QVWDSSSDHVV

SEQ ID NO: 12565 - protein, 11 aa, Artificial Sequence
  Description of Artificial Sequence: Synthetic peptide
QVWDSSSDHVV

SEQ ID NO: 12566 - protein, 11 aa, Artificial Sequence
  Description of Artificial Sequence: Synthetic peptide
QVWDSSSDHVI

SEQ ID NO: 12567 - protein, 11 aa, Artificial Sequence
  Description of Artificial Sequence: Synthetic peptide
QVWDSSSDHVV

SEQ ID NO: 12568 - protein, 11 aa, Artificial Sequence
  Description of Artificial Sequence: Synthetic peptide
QVWDSSSDHVV

SEQ ID NO: 12569 - protein, 11 aa, Artificial Sequence
  Description of Artificial Sequence: Synthetic peptide
QVWDSSSDHVV

SEQ ID NO: 12570 - protein, 11 aa, Artificial Sequence
  Description of Artificial Sequence: Synthetic peptide
QVWDYSSDHVV

SEQ ID NO: 12571 - protein, 11 aa, Artificial Sequence
  Description of Artificial Sequence: Synthetic peptide
QVWDYSSDHVV

SEQ ID NO: 12572 - protein, 11 aa, Artificial Sequence
  Description of Artificial Sequence: Synthetic peptide
QVWDSSSDHVV

SEQ ID NO: 12573 - protein, 11 aa, Artificial Sequence
  Description of Artificial Sequence: Synthetic peptide
QVWDSSSDHVV

SEQ ID NO: 12574 - protein, 11 aa, Artificial Sequence
  Description of Artificial Sequence: Synthetic peptide
QVWDYRYLSQV

SEQ ID NO: 12575 - protein, 11 aa, Artificial Sequence
  Description of Artificial Sequence: Synthetic peptide
QVWDYSGQRQV

SEQ ID NO: 12576 - protein, 12 aa, Artificial Sequence
  Description of Artificial Sequence: Synthetic peptide
QVWDASAGYGVV

SEQ ID NO: 12577 - protein, 11 aa, Artificial Sequence
  Description of Artificial Sequence: Synthetic peptide
QVWDYSPLRHV

SEQ ID NO: 12578 - protein, 11 aa, Artificial Sequence
  Description of Artificial Sequence: Synthetic peptide
QVWDYYSNRAV

SEQ ID NO: 12579 - protein, 11 aa, Artificial Sequence
  Description of Artificial Sequence: Synthetic peptide
QVWDYRYLSQV

SEQ ID NO: 12580 - protein, 11 aa, Artificial Sequence
  Description of Artificial Sequence: Synthetic peptide
QVWDYRYLSQV

SEQ ID NO: 12581 - protein, 11 aa, Artificial Sequence
  Description of Artificial Sequence: Synthetic peptide
QVWDYSGQRQV

SEQ ID NO: 12582 - protein, 11 aa, Artificial Sequence
  Description of Artificial Sequence: Synthetic peptide
QVWDYSGQRQV

SEQ ID NO: 12583 - protein, 11 aa, Artificial Sequence
  Description of Artificial Sequence: Synthetic peptide
QVWDYVAPRHV

SEQ ID NO: 12584 - protein, 11 aa, Artificial Sequence
  Description of Artificial Sequence: Synthetic peptide
QVWDYVAPRHV

SEQ ID NO: 12585 - protein, 11 aa, Artificial Sequence
  Description of Artificial Sequence: Synthetic peptide
QVWDSSSDHWV

SEQ ID NO: 12586 - protein, 11 aa, Artificial Sequence
  Description of Artificial Sequence: Synthetic peptide
QVWDYRTLDWV

SEQ ID NO: 12587 - protein, 11 aa, Artificial Sequence
  Description of Artificial Sequence: Synthetic peptide
QVWDYRTLDWV

SEQ ID NO: 12588 - protein, 13 aa, Artificial Sequence
  Description of Artificial Sequence: Synthetic peptide
DIVVVVAATYFDY

SEQ ID NO: 12589 - protein, 10 aa, Artificial Sequence
  Description of Artificial Sequence: Synthetic peptide
DGVFYAPLAY

SEQ ID NO: 12590 - protein, 10 aa, Artificial Sequence
  Description of Artificial Sequence: Synthetic peptide
GYSYGYYFDY

SEQ ID NO: 12591 - protein, 13 aa, Artificial Sequence
  Description of Artificial Sequence: Synthetic peptide
GNYFGSSEAYFDY

SEQ ID NO: 12592 - protein, 10 aa, Artificial Sequence
  Description of Artificial Sequence: Synthetic peptide
VQLERDAFDI

SEQ ID NO: 12593 - protein, 11 aa, Artificial Sequence
  Description of Artificial Sequence: Synthetic peptide
RQLNHVFAMDY

SEQ ID NO: 12594 - protein, 15 aa, Artificial Sequence
  Description of Artificial Sequence: Synthetic peptide
GYSYGYYYYYYGMDV

SEQ ID NO: 12595 - protein, 14 aa, Artificial Sequence
  Description of Artificial Sequence: Synthetic peptide
GGGYSNGYDYGMDV

SEQ ID NO: 12596 - protein, 14 aa, Artificial Sequence
  Description of Artificial Sequence: Synthetic peptide
GGGYSNGYDYGMDV

SEQ ID NO: 12597 - protein, 16 aa, Artificial Sequence
  Description of Artificial Sequence: Synthetic peptide
GYSGYDYYYYYYGMDV

SEQ ID NO: 12598 - protein, 14 aa, Artificial Sequence
  Description of Artificial Sequence: Synthetic peptide
GGGYSYGYDYGMDV

SEQ ID NO: 12599 - protein, 14 aa, Artificial Sequence
  Description of Artificial Sequence: Synthetic peptide
GGGYSYGYDYGMDV

SEQ ID NO: 12600 - protein, 14 aa, Artificial Sequence
  Description of Artificial Sequence: Synthetic peptide
GGGYSYGYDYGMDV

SEQ ID NO: 12601 - protein, 15 aa, Artificial Sequence
  Description of Artificial Sequence: Synthetic peptide
GYSYGYYYYYYGMDV

SEQ ID NO: 12602 - protein, 14 aa, Artificial Sequence
  Description of Artificial Sequence: Synthetic peptide
GGGYSHGYDYGMDV

SEQ ID NO: 12603 - protein, 14 aa, Artificial Sequence
  Description of Artificial Sequence: Synthetic peptide
GGGYSDGYDYGMDV

SEQ ID NO: 12604 - protein, 14 aa, Artificial Sequence
  Description of Artificial Sequence: Synthetic peptide
GGGYSDGYDYGMDV

SEQ ID NO: 12605 - protein, 14 aa, Artificial Sequence
  Description of Artificial Sequence: Synthetic peptide
GGGYSHGYDYGMDV

SEQ ID NO: 12606 - protein, 14 aa, Artificial Sequence
  Description of Artificial Sequence: Synthetic peptide
GGGYSDGYDYGMDV

SEQ ID NO: 12607 - protein, 14 aa, Artificial Sequence
  Description of Artificial Sequence: Synthetic peptide
GGGYSHGYDYGMDV

SEQ ID NO: 12608 - protein, 14 aa, Artificial Sequence
  Description of Artificial Sequence: Synthetic peptide
GGGYSDGYDYGMDV

SEQ ID NO: 12609 - protein, 14 aa, Artificial Sequence
  Description of Artificial Sequence: Synthetic peptide
GGGYSDGYDYGMDV

SEQ ID NO: 12610 - protein, 14 aa, Artificial Sequence
  Description of Artificial Sequence: Synthetic peptide
GGGYSDGYDYGMDV

SEQ ID NO: 12611 - protein, 14 aa, Artificial Sequence
  Description of Artificial Sequence: Synthetic peptide
GGGYSDGYDYGMDV

SEQ ID NO: 12612 - protein, 9 aa, Artificial Sequence
  Description of Artificial Sequence: Synthetic peptide
VLRYFDWLL

SEQ ID NO: 12613 - protein, 4 aa, Artificial Sequence
  Description of Artificial Sequence: Synthetic peptide
YFDY

SEQ ID NO: 12614 - protein, 11 aa, Artificial Sequence
  Description of Artificial Sequence: Synthetic peptide
HLRYFDWPLDY

SEQ ID NO: 12615 - protein, 11 aa, Artificial Sequence
  Description of Artificial Sequence: Synthetic peptide
HLRYSDWPLDY

SEQ ID NO: 12616 - protein, 11 aa, Artificial Sequence
  Description of Artificial Sequence: Synthetic peptide
HLRYFDWPLDY

SEQ ID NO: 12617 - protein, 11 aa, Artificial Sequence
  Description of Artificial Sequence: Synthetic peptide
HLRYSDWPLDY

SEQ ID NO: 12618 - protein, 11 aa, Artificial Sequence
  Description of Artificial Sequence: Synthetic peptide
HLRYFDWPLDY

SEQ ID NO: 12619 - protein, 14 aa, Artificial Sequence
  Description of Artificial Sequence: Synthetic peptide
VQLERYYYYYGMDV

SEQ ID NO: 12620 - protein, 12 aa, Artificial Sequence
  Description of Artificial Sequence: Synthetic peptide
EQWPNYYYGMDV

SEQ ID NO: 12621 - protein, 12 aa, Artificial Sequence
  Description of Artificial Sequence: Synthetic peptide
EQWPNYYYGLGV

SEQ ID NO: 12622 - protein, 16 aa, Artificial Sequence
  Description of Artificial Sequence: Synthetic peptide
GYSGYDYYYYYYGMDV

SEQ ID NO: 12623 - protein, 14 aa, Artificial Sequence
  Description of Artificial Sequence: Synthetic peptide
GGGYSYGYDYGMDV

SEQ ID NO: 12624 - protein, 14 aa, Artificial Sequence
  Description of Artificial Sequence: Synthetic peptide
GGGYSYGYDYGMDV

SEQ ID NO: 12625 - protein, 14 aa, Artificial Sequence
  Description of Artificial Sequence: Synthetic peptide
GGGYSYGYDYGMDV

SEQ ID NO: 12626 - protein, 14 aa, Artificial Sequence
  Description of Artificial Sequence: Synthetic peptide
GGGYSYGYDYGMDV

SEQ ID NO: 12627 - protein, 14 aa, Artificial Sequence
  Description of Artificial Sequence: Synthetic peptide
GGGYSYGYDYGMDV

SEQ ID NO: 12628 - protein, 14 aa, Artificial Sequence
  Description of Artificial Sequence: Synthetic peptide
GGGYSYGYDYGMDV

SEQ ID NO: 12629 - protein, 14 aa, Artificial Sequence
  Description of Artificial Sequence: Synthetic peptide
GGGYSYGYDYGMDV

SEQ ID NO: 12630 - protein, 14 aa, Artificial Sequence
  Description of Artificial Sequence: Synthetic peptide
GGGYSYGYDYGMDV

SEQ ID NO: 12631 - protein, 14 aa, Artificial Sequence
  Description of Artificial Sequence: Synthetic peptide
GGGYSYGYDYGMDV

SEQ ID NO: 12632 - protein, 16 aa, Artificial Sequence
  Description of Artificial Sequence: Synthetic peptide
GYSSGWYYYYYYGMDV

SEQ ID NO: 12633 - protein, 17 aa, Artificial Sequence
  Description of Artificial Sequence: Synthetic peptide
DGGSGWFPKLLHYGLDV

SEQ ID NO: 12634 - protein, 17 aa, Artificial Sequence
  Description of Artificial Sequence: Synthetic peptide
DGGSGWFPKLLHYGLDV

SEQ ID NO: 12635 - protein, 17 aa, Artificial Sequence
  Description of Artificial Sequence: Synthetic peptide
DGGSGWFPKLLHYGLDV

SEQ ID NO: 12636 - protein, 17 aa, Artificial Sequence
  Description of Artificial Sequence: Synthetic peptide
DGGSGWFPKLLHYGLDV

SEQ ID NO: 12637 - protein, 12 aa, Artificial Sequence
  Description of Artificial Sequence: Synthetic peptide
LTGYYYYYGMDV

SEQ ID NO: 12638 - protein, 12 aa, Artificial Sequence
  Description of Artificial Sequence: Synthetic peptide
LVTPDYYYGMDV

SEQ ID NO: 12639 - protein, 16 aa, Artificial Sequence
  Description of Artificial Sequence: Synthetic peptide
QGGIAAAYYYYDGMDV

SEQ ID NO: 12640 - protein, 15 aa, Artificial Sequence
  Description of Artificial Sequence: Synthetic peptide
GEGISARYYYYGMDV

SEQ ID NO: 12641 - protein, 15 aa, Artificial Sequence
  Description of Artificial Sequence: Synthetic peptide
VDTAMVYYYYYGMDV

SEQ ID NO: 12642 - protein, 12 aa, Artificial Sequence
  Description of Artificial Sequence: Synthetic peptide
VMTPDYYYDMDV

SEQ ID NO: 12643 - protein, 12 aa, Artificial Sequence
  Description of Artificial Sequence: Synthetic peptide
VMTPDYYYDMDV

SEQ ID NO: 12644 - protein, 12 aa, Artificial Sequence
  Description of Artificial Sequence: Synthetic peptide
VMTPDYYYDMDV

SEQ ID NO: 12645 - protein, 9 aa, Artificial Sequence
  Description of Artificial Sequence: Synthetic peptide
VLLWFGELL

SEQ ID NO: 12646 - protein, 9 aa, Artificial Sequence
  Description of Artificial Sequence: Synthetic peptide
YYYYYGMDV

SEQ ID NO: 12647 - protein, 16 aa, Artificial Sequence
  Description of Artificial Sequence: Synthetic peptide
DKLWFGKLNYYYGMDV

SEQ ID NO: 12648 - protein, 16 aa, Artificial Sequence
  Description of Artificial Sequence: Synthetic peptide
DLLWFGKLNYYYGMDV

SEQ ID NO: 12649 - protein, 16 aa, Artificial Sequence
  Description of Artificial Sequence: Synthetic peptide
DRLWFGVLNYYYGMDV

SEQ ID NO: 12650 - protein, 16 aa, Artificial Sequence
  Description of Artificial Sequence: Synthetic peptide
DRLWFGVLNYYYGMDV

SEQ ID NO: 12651 - protein, 16 aa, Artificial Sequence
  Description of Artificial Sequence: Synthetic peptide
DQLWFGVLNYYYGMDV

SEQ ID NO: 12652 - protein, 16 aa, Artificial Sequence
  Description of Artificial Sequence: Synthetic peptide
DRLWFGVLNYYYGMDV

SEQ ID NO: 12653 - protein, 16 aa, Artificial Sequence
  Description of Artificial Sequence: Synthetic peptide
DQLWFGVLNYYYGMDV

SEQ ID NO: 12654 - protein, 16 aa, Artificial Sequence
  Description of Artificial Sequence: Synthetic peptide
DRLWFGVLNYYYGMDV

SEQ ID NO: 12655 - protein, 16 aa, Artificial Sequence
  Description of Artificial Sequence: Synthetic peptide
DRLWFGVLNYYYGMDV

SEQ ID NO: 12656 - protein, 16 aa, Artificial Sequence
  Description of Artificial Sequence: Synthetic peptide
DQLWFGVLNYYYGMDV

SEQ ID NO: 12657 - protein, 16 aa, Artificial Sequence
  Description of Artificial Sequence: Synthetic peptide
DQLWFGVLNYYYGMDV

SEQ ID NO: 12658 - protein, 16 aa, Artificial Sequence
  Description of Artificial Sequence: Synthetic peptide
DLLWFGKLNYYYGLDV

SEQ ID NO: 12659 - protein, 16 aa, Artificial Sequence
  Description of Artificial Sequence: Synthetic peptide
DLLWFGKLNYYYGLDV

SEQ ID NO: 12660 - protein, 16 aa, Artificial Sequence
  Description of Artificial Sequence: Synthetic peptide
DRLWFGVLNYYYGMDV

SEQ ID NO: 12661 - protein, 16 aa, Artificial Sequence
  Description of Artificial Sequence: Synthetic peptide
DRLWFGVLNYYYGMDV

SEQ ID NO: 12662 - protein, 16 aa, Artificial Sequence
  Description of Artificial Sequence: Synthetic peptide
DRLWFGVLNYYYGMDV

SEQ ID NO: 12663 - protein, 16 aa, Artificial Sequence
  Description of Artificial Sequence: Synthetic peptide
DRLWFGVLNYYYGMDV

SEQ ID NO: 12664 - protein, 16 aa, Artificial Sequence
  Description of Artificial Sequence: Synthetic peptide
DRLWFGVLNYYYGMDV

SEQ ID NO: 12665 - protein, 14 aa, Artificial Sequence
  Description of Artificial Sequence: Synthetic peptide
GTTGTYYYYYGMDV

SEQ ID NO: 12666 - protein, 12 aa, Artificial Sequence
  Description of Artificial Sequence: Synthetic peptide
MVTPDYYYDMDV

SEQ ID NO: 12667 - protein, 19 aa, Artificial Sequence
  Description of Artificial Sequence: Synthetic peptide
YYYGSGSYYNYYYYYGMDV

SEQ ID NO: 12668 - protein, 17 aa, Artificial Sequence
  Description of Artificial Sequence: Synthetic peptide
NYGSGSYGAYYYHGMDV

SEQ ID NO: 12669 - protein, 17 aa, Artificial Sequence
  Description of Artificial Sequence: Synthetic peptide
NYGSGSYGAYYYHGMDV

SEQ ID NO: 12670 - protein, 12 aa, Artificial Sequence
  Description of Artificial Sequence: Synthetic peptide
NWGYYYYYGMDV

SEQ ID NO: 12671 - protein, 12 aa, Artificial Sequence
  Description of Artificial Sequence: Synthetic peptide
GWGTYYYYGMDV

SEQ ID NO: 12672 - protein, 12 aa, Artificial Sequence
  Description of Artificial Sequence: Synthetic peptide
GWGRYYSYGMDV

SEQ ID NO: 12673 - protein, 12 aa, Artificial Sequence
  Description of Artificial Sequence: Synthetic peptide
GWGRFYSYGMDV

SEQ ID NO: 12674 - protein, 12 aa, Artificial Sequence
  Description of Artificial Sequence: Synthetic peptide
GWGTYYYYGMDV

SEQ ID NO: 12675 - protein, 12 aa, Artificial Sequence
  Description of Artificial Sequence: Synthetic peptide
GWGTYYYYGMDV

SEQ ID NO: 12676 - protein, 14 aa, Artificial Sequence
  Description of Artificial Sequence: Synthetic peptide
SIAARYYYYYGMDV

SEQ ID NO: 12677 - protein, 12 aa, Artificial Sequence
  Description of Artificial Sequence: Synthetic peptide
SKAARPDDGMDV

SEQ ID NO: 12678 - protein, 19 aa, Artificial Sequence
  Description of Artificial Sequence: Synthetic peptide
YYYGSGSYYNYYYYYGMDV

SEQ ID NO: 12679 - protein, 17 aa, Artificial Sequence
  Description of Artificial Sequence: Synthetic peptide
NYGSGSYGAYYYHGMDV

SEQ ID NO: 12680 - protein, 17 aa, Artificial Sequence
  Description of Artificial Sequence: Synthetic peptide
NYGSGSYGAYYYYGMDV

SEQ ID NO: 12681 - protein, 13 aa, Artificial Sequence
  Description of Artificial Sequence: Synthetic peptide
ITIFGVVIIYFDY

SEQ ID NO: 12682 - protein, 11 aa, Artificial Sequence
  Description of Artificial Sequence: Synthetic peptide
GIFGVITYFDY

SEQ ID NO: 12683 - protein, 11 aa, Artificial Sequence
  Description of Artificial Sequence: Synthetic peptide
GIFGVITYFDY

SEQ ID NO: 12684 - protein, 11 aa, Artificial Sequence
  Description of Artificial Sequence: Synthetic peptide
GIFGVITYFDY

SEQ ID NO: 12685 - protein, 11 aa, Artificial Sequence
  Description of Artificial Sequence: Synthetic peptide
GIFGVITYFDY

SEQ ID NO: 12686 - protein, 9 aa, Artificial Sequence
  Description of Artificial Sequence: Synthetic peptide
VLLWFGELL

SEQ ID NO: 12687 - protein, 9 aa, Artificial Sequence
  Description of Artificial Sequence: Synthetic peptide
YYYYYGMDV

SEQ ID NO: 12688 - protein, 16 aa, Artificial Sequence
  Description of Artificial Sequence: Synthetic peptide
EVLWFGKLNYYYGMDV

SEQ ID NO: 12689 - protein, 14 aa, Artificial Sequence
  Description of Artificial Sequence: Synthetic peptide
ITIFGVVIINWFDP

SEQ ID NO: 12690 - protein, 11 aa, Artificial Sequence
  Description of Artificial Sequence: Synthetic peptide
TIFGVVGWFDP

SEQ ID NO: 12691 - protein, 8 aa, Artificial Sequence
  Description of Artificial Sequence: Synthetic peptide
LLLNWFDP

SEQ ID NO: 12692 - protein, 13 aa, Artificial Sequence
  Description of Artificial Sequence: Synthetic peptide
RRYNWNYENWFDP

SEQ ID NO: 12693 - protein, 13 aa, Artificial Sequence
  Description of Artificial Sequence: Synthetic peptide
RRYNWNYENWFDP

SEQ ID NO: 12694 - protein, 13 aa, Artificial Sequence
  Description of Artificial Sequence: Synthetic peptide
RRYNWNYENWFDP

SEQ ID NO: 12695 - protein, 15 aa, Artificial Sequence
  Description of Artificial Sequence: Synthetic peptide
GIVGATYYYYYGMDV

SEQ ID NO: 12696 - protein, 15 aa, Artificial Sequence
  Description of Artificial Sequence: Synthetic peptide
GEGIAARYYYYGMDV

SEQ ID NO: 12697 - protein, 14 aa, Artificial Sequence
  Description of Artificial Sequence: Synthetic peptide
ITIFGVVIINWFDP

SEQ ID NO: 12698 - protein, 11 aa, Artificial Sequence
  Description of Artificial Sequence: Synthetic peptide
TIFGVVGWFDP

SEQ ID NO: 12699 - protein, 8 aa, Artificial Sequence
  Description of Artificial Sequence: Synthetic peptide
LLLNWFDP

SEQ ID NO: 12700 - protein, 13 aa, Artificial Sequence
  Description of Artificial Sequence: Synthetic peptide
RRYNWNYENWFDP

SEQ ID NO: 12701 - protein, 13 aa, Artificial Sequence
  Description of Artificial Sequence: Synthetic peptide
RRYNWNYENWFDP

SEQ ID NO: 12702 - protein, 13 aa, Artificial Sequence
  Description of Artificial Sequence: Synthetic peptide
RRYNWNYENWFDP

SEQ ID NO: 12703 - protein, 13 aa, Artificial Sequence
  Description of Artificial Sequence: Synthetic peptide
RRYNWNYENWFDP

SEQ ID NO: 12704 - protein, 13 aa, Artificial Sequence
  Description of Artificial Sequence: Synthetic peptide
RRYNWNYENWFDP

SEQ ID NO: 12705 - protein, 13 aa, Artificial Sequence
  Description of Artificial Sequence: Synthetic peptide
RRYNWNYENWFDP

SEQ ID NO: 12706 - protein, 13 aa, Artificial Sequence
  Description of Artificial Sequence: Synthetic peptide
RRYNWNYENWFDP

SEQ ID NO: 12707 - protein, 13 aa, Artificial Sequence
  Description of Artificial Sequence: Synthetic peptide
RRYNWNYENWFDP

SEQ ID NO: 12708 - protein, 13 aa, Artificial Sequence
  Description of Artificial Sequence: Synthetic peptide
RRYNWNYENWFDP

SEQ ID NO: 12709 - protein, 13 aa, Artificial Sequence
  Description of Artificial Sequence: Synthetic peptide
RRYNWNYENWFDP

SEQ ID NO: 12710 - protein, 11 aa, Artificial Sequence
  Description of Artificial Sequence: Synthetic peptide
LGYYYYYGMDV

SEQ ID NO: 12711 - protein, 12 aa, Artificial Sequence
  Description of Artificial Sequence: Synthetic peptide
TLTPDYYYDMDV

SEQ ID NO: 12712 - protein, 12 aa, Artificial Sequence
  Description of Artificial Sequence: Synthetic peptide
ALTPDYYYDMDV

SEQ ID NO: 12713 - protein, 18 aa, Artificial Sequence
  Description of Artificial Sequence: Synthetic peptide
ITMVRGVIIYYYYYGMDV

SEQ ID NO: 12714 - protein, 16 aa, Artificial Sequence
  Description of Artificial Sequence: Synthetic peptide
EKMWFGVLNYYYGMDV

SEQ ID NO: 12715 - protein, 16 aa, Artificial Sequence
  Description of Artificial Sequence: Synthetic peptide
EKMWFGVLNYYYGMDV

SEQ ID NO: 12716 - protein, 16 aa, Artificial Sequence
  Description of Artificial Sequence: Synthetic peptide
EKMWFGVLNYYYGMDV

SEQ ID NO: 12717 - protein, 16 aa, Artificial Sequence
  Description of Artificial Sequence: Synthetic peptide
EKMWFGVLNYYYGMDV

SEQ ID NO: 12718 - protein, 16 aa, Artificial Sequence
  Description of Artificial Sequence: Synthetic peptide
EKMWFGVLNYYYGMDV

SEQ ID NO: 12719 - protein, 16 aa, Artificial Sequence
  Description of Artificial Sequence: Synthetic peptide
EKMWFGVLNYYYGMDV

SEQ ID NO: 12720 - protein, 19 aa, Artificial Sequence
  Description of Artificial Sequence: Synthetic peptide
YYYGSGSYYNYYYYYGMDV

SEQ ID NO: 12721 - protein, 16 aa, Artificial Sequence
  Description of Artificial Sequence: Synthetic peptide
PSNSGSYYNYFSVMDV

SEQ ID NO: 12722 - protein, 16 aa, Artificial Sequence
  Description of Artificial Sequence: Synthetic peptide
PSNSGSYYNYFSVMDV

SEQ ID NO: 12723 - protein, 16 aa, Artificial Sequence
  Description of Artificial Sequence: Synthetic peptide
PSNSGSYYNYFSVMDV

SEQ ID NO: 12724 - protein, 16 aa, Artificial Sequence
  Description of Artificial Sequence: Synthetic peptide
PSYSGSYYNYFSVMDV

SEQ ID NO: 12725 - protein, 16 aa, Artificial Sequence
  Description of Artificial Sequence: Synthetic peptide
PSNSGSYYNYFSVMDV

SEQ ID NO: 12726 - protein, 16 aa, Artificial Sequence
  Description of Artificial Sequence: Synthetic peptide
PSNGGSYYNYFSVMDV

SEQ ID NO: 12727 - protein, 16 aa, Artificial Sequence
  Description of Artificial Sequence: Synthetic peptide
PSYSGSYYNYFSVMDV

SEQ ID NO: 12728 - protein, 16 aa, Artificial Sequence
  Description of Artificial Sequence: Synthetic peptide
PSYSGSYYNYFSVMDV

SEQ ID NO: 12729 - protein, 16 aa, Artificial Sequence
  Description of Artificial Sequence: Synthetic peptide
PSNSGSYYNYFSVMDV

SEQ ID NO: 12730 - protein, 16 aa, Artificial Sequence
  Description of Artificial Sequence: Synthetic peptide
PSYSGSYYNYFSVMDV

SEQ ID NO: 12731 - protein, 16 aa, Artificial Sequence
  Description of Artificial Sequence: Synthetic peptide
PSYSGSYYNYFSVMDV

SEQ ID NO: 12732 - protein, 16 aa, Artificial Sequence
  Description of Artificial Sequence: Synthetic peptide
PSYSGSYYNYFSVMDV

SEQ ID NO: 12733 - protein, 16 aa, Artificial Sequence
  Description of Artificial Sequence: Synthetic peptide
PSNSGSYYNYFSVMDV

SEQ ID NO: 12734 - protein, 16 aa, Artificial Sequence
  Description of Artificial Sequence: Synthetic peptide
PSYSGSYYNYFSVMDV

SEQ ID NO: 12735 - protein, 16 aa, Artificial Sequence
  Description of Artificial Sequence: Synthetic peptide
PSYSGSYYNYFSVMDV

SEQ ID NO: 12736 - protein, 16 aa, Artificial Sequence
  Description of Artificial Sequence: Synthetic peptide
PSYSGSYYNYFSVMDV

SEQ ID NO: 12737 - protein, 16 aa, Artificial Sequence
  Description of Artificial Sequence: Synthetic peptide
PSYSGSYYNYFSVMDV

SEQ ID NO: 12738 - protein, 16 aa, Artificial Sequence
  Description of Artificial Sequence: Synthetic peptide
PSYSGSYYNYFSVMDV

SEQ ID NO: 12739 - protein, 16 aa, Artificial Sequence
  Description of Artificial Sequence: Synthetic peptide
PSYSGSYYNYFSVMDV

SEQ ID NO: 12740 - protein, 16 aa, Artificial Sequence
  Description of Artificial Sequence: Synthetic peptide
PSYSGSYYNYFSVMDV

SEQ ID NO: 12741 - protein, 16 aa, Artificial Sequence
  Description of Artificial Sequence: Synthetic peptide
PSYSGSYYNYFSVMDV

SEQ ID NO: 12742 - protein, 16 aa, Artificial Sequence
  Description of Artificial Sequence: Synthetic peptide
PSYSGSYYNYFSVMDV

SEQ ID NO: 12743 - protein, 16 aa, Artificial Sequence
  Description of Artificial Sequence: Synthetic peptide
PSYSGSYYNYFSVMDV

SEQ ID NO: 12744 - protein, 18 aa, Artificial Sequence
  Description of Artificial Sequence: Synthetic peptide
ITMVRGVIIYYYYYGMDV

SEQ ID NO: 12745 - protein, 16 aa, Artificial Sequence
  Description of Artificial Sequence: Synthetic peptide
EKMWFGVLNYYYGMDV

SEQ ID NO: 12746 - protein, 16 aa, Artificial Sequence
  Description of Artificial Sequence: Synthetic peptide
EKMWFGVLNYYYGMDV

SEQ ID NO: 12747 - protein, 16 aa, Artificial Sequence
  Description of Artificial Sequence: Synthetic peptide
EKMWFGVLNYYYGMDV

SEQ ID NO: 12748 - protein, 10 aa, Artificial Sequence
  Description of Artificial Sequence: Synthetic peptide
GIAVAGYFDY

SEQ ID NO: 12749 - protein, 10 aa, Artificial Sequence
  Description of Artificial Sequence: Synthetic peptide
GKGVHLGFDY

SEQ ID NO: 12750 - protein, 10 aa, Artificial Sequence
  Description of Artificial Sequence: Synthetic peptide
GKGVHLNFDY

SEQ ID NO: 12751 - protein, 10 aa, Artificial Sequence
  Description of Artificial Sequence: Synthetic peptide
GKGVHLGFDY

SEQ ID NO: 12752 - protein, 10 aa, Artificial Sequence
  Description of Artificial Sequence: Synthetic peptide
GKGVHLGFDY

SEQ ID NO: 12753 - protein, 10 aa, Artificial Sequence
  Description of Artificial Sequence: Synthetic peptide
GKGVHLGFDY

SEQ ID NO: 12754 - protein, 10 aa, Artificial Sequence
  Description of Artificial Sequence: Synthetic peptide
GKGVHLGFDY

SEQ ID NO: 12755 - protein, 10 aa, Artificial Sequence
  Description of Artificial Sequence: Synthetic peptide
GKGVHLGFDY

SEQ ID NO: 12756 - protein, 10 aa, Artificial Sequence
  Description of Artificial Sequence: Synthetic peptide
GKGVHLGFDY

SEQ ID NO: 12757 - protein, 10 aa, Artificial Sequence
  Description of Artificial Sequence: Synthetic peptide
GKGVHLGFDY

SEQ ID NO: 12758 - protein, 10 aa, Artificial Sequence
  Description of Artificial Sequence: Synthetic peptide
GKGVHLNFDY

SEQ ID NO: 12759 - protein, 10 aa, Artificial Sequence
  Description of Artificial Sequence: Synthetic peptide
GKGVHLGFDY

SEQ ID NO: 12760 - protein, 10 aa, Artificial Sequence
  Description of Artificial Sequence: Synthetic peptide
GKGVHLGFDY

SEQ ID NO: 12761 - protein, 10 aa, Artificial Sequence
  Description of Artificial Sequence: Synthetic peptide
GKGVHLGFDY

SEQ ID NO: 12762 - protein, 10 aa, Artificial Sequence
  Description of Artificial Sequence: Synthetic peptide
GKGVHLNFDY

SEQ ID NO: 12763 - protein, 10 aa, Artificial Sequence
  Description of Artificial Sequence: Synthetic peptide
GKGVHLGFDY

SEQ ID NO: 12764 - protein, 10 aa, Artificial Sequence
  Description of Artificial Sequence: Synthetic peptide
GKGVHLGFDY

SEQ ID NO: 12765 - protein, 10 aa, Artificial Sequence
  Description of Artificial Sequence: Synthetic peptide
GKGVHLNFDY

SEQ ID NO: 12766 - protein, 10 aa, Artificial Sequence
  Description of Artificial Sequence: Synthetic peptide
GKGVHLGFDY

SEQ ID NO: 12767 - protein, 10 aa, Artificial Sequence
  Description of Artificial Sequence: Synthetic peptide
GKGVHLNFDY

SEQ ID NO: 12768 - protein, 10 aa, Artificial Sequence
  Description of Artificial Sequence: Synthetic peptide
GKGVHLNFDY

SEQ ID NO: 12769 - protein, 10 aa, Artificial Sequence
  Description of Artificial Sequence: Synthetic peptide
GKGVHLGFDY

SEQ ID NO: 12770 - protein, 10 aa, Artificial Sequence
  Description of Artificial Sequence: Synthetic peptide
GKGVHLGFDY

SEQ ID NO: 12771 - protein, 10 aa, Artificial Sequence
  Description of Artificial Sequence: Synthetic peptide
GKGVHLGFDY

SEQ ID NO: 12772 - protein, 10 aa, Artificial Sequence
  Description of Artificial Sequence: Synthetic peptide
GKGVHLGFDY

SEQ ID NO: 12773 - protein, 10 aa, Artificial Sequence
  Description of Artificial Sequence: Synthetic peptide
GKGVHLNFDY

SEQ ID NO: 12774 - protein, 10 aa, Artificial Sequence
  Description of Artificial Sequence: Synthetic peptide
GKGVHLNFDY

SEQ ID NO: 12775 - protein, 10 aa, Artificial Sequence
  Description of Artificial Sequence: Synthetic peptide
GKGVHLGFDY

SEQ ID NO: 12776 - protein, 10 aa, Artificial Sequence
  Description of Artificial Sequence: Synthetic peptide
GKGVHLGFDY

SEQ ID NO: 12777 - protein, 10 aa, Artificial Sequence
  Description of Artificial Sequence: Synthetic peptide
GKGVHLGFDY

SEQ ID NO: 12778 - protein, 10 aa, Artificial Sequence
  Description of Artificial Sequence: Synthetic peptide
GKGVHLGFDY

SEQ ID NO: 12779 - protein, 10 aa, Artificial Sequence
  Description of Artificial Sequence: Synthetic peptide
GKGVHLGFDY

SEQ ID NO: 12780 - protein, 10 aa, Artificial Sequence
  Description of Artificial Sequence: Synthetic peptide
GKGVHLGFDY

SEQ ID NO: 12781 - protein, 10 aa, Artificial Sequence
  Description of Artificial Sequence: Synthetic peptide
GKGVHLGFDY

SEQ ID NO: 12782 - protein, 10 aa, Artificial Sequence
  Description of Artificial Sequence: Synthetic peptide
GKGVHLGFDY

SEQ ID NO: 12783 - protein, 10 aa, Artificial Sequence
  Description of Artificial Sequence: Synthetic peptide
GKGVHLGFDY

SEQ ID NO: 12784 - protein, 10 aa, Artificial Sequence
  Description of Artificial Sequence: Synthetic peptide
GKGVHLNFDY

SEQ ID NO: 12785 - protein, 10 aa, Artificial Sequence
  Description of Artificial Sequence: Synthetic peptide
GKGVHLGFDY

SEQ ID NO: 12786 - protein, 10 aa, Artificial Sequence
  Description of Artificial Sequence: Synthetic peptide
GKGVHLGFDY

SEQ ID NO: 12787 - protein, 10 aa, Artificial Sequence
  Description of Artificial Sequence: Synthetic peptide
GKGVHLGFDY

SEQ ID NO: 12788 - protein, 10 aa, Artificial Sequence
  Description of Artificial Sequence: Synthetic peptide
GKGVHLNFDY

SEQ ID NO: 12789 - protein, 10 aa, Artificial Sequence
  Description of Artificial Sequence: Synthetic peptide
GKGVHLNFDY

SEQ ID NO: 12790 - protein, 10 aa, Artificial Sequence
  Description of Artificial Sequence: Synthetic peptide
GKGVHLGFDY

SEQ ID NO: 12791 - protein, 10 aa, Artificial Sequence
  Description of Artificial Sequence: Synthetic peptide
GKGVHLGFDY

SEQ ID NO: 12792 - protein, 10 aa, Artificial Sequence
  Description of Artificial Sequence: Synthetic peptide
GKGVHLGFDY

SEQ ID NO: 12793 - protein, 10 aa, Artificial Sequence
  Description of Artificial Sequence: Synthetic peptide
GKGVHLGFDY

SEQ ID NO: 12794 - protein, 10 aa, Artificial Sequence
  Description of Artificial Sequence: Synthetic peptide
GKGVHLGFDY

SEQ ID NO: 12795 - protein, 10 aa, Artificial Sequence
  Description of Artificial Sequence: Synthetic peptide
GKGVHLGFDY

SEQ ID NO: 12796 - protein, 10 aa, Artificial Sequence
  Description of Artificial Sequence: Synthetic peptide
GKGVHLGFDY

SEQ ID NO: 12797 - protein, 10 aa, Artificial Sequence
  Description of Artificial Sequence: Synthetic peptide
GKGVHLGFDY

SEQ ID NO: 12798 - protein, 10 aa, Artificial Sequence
  Description of Artificial Sequence: Synthetic peptide
GKGVHLGFDY

SEQ ID NO: 12799 - protein, 10 aa, Artificial Sequence
  Description of Artificial Sequence: Synthetic peptide
GKGVHLGFDY

SEQ ID NO: 12800 - protein, 10 aa, Artificial Sequence
  Description of Artificial Sequence: Synthetic peptide
GKGVHLGFDY

SEQ ID NO: 12801 - protein, 10 aa, Artificial Sequence
  Description of Artificial Sequence: Synthetic peptide
GKGVHLGFDY

SEQ ID NO: 12802 - protein, 10 aa, Artificial Sequence
  Description of Artificial Sequence: Synthetic peptide
GKGVHLGFDY

SEQ ID NO: 12803 - protein, 10 aa, Artificial Sequence
  Description of Artificial Sequence: Synthetic peptide
GKGVHLGFDY

SEQ ID NO: 12804 - protein, 10 aa, Artificial Sequence
  Description of Artificial Sequence: Synthetic peptide
GKGVHLGFDY

SEQ ID NO: 12805 - protein, 10 aa, Artificial Sequence
  Description of Artificial Sequence: Synthetic peptide
GKGVHLGFDY

SEQ ID NO: 12806 - protein, 12 aa, Artificial Sequence
  Description of Artificial Sequence: Synthetic peptide
GIAVAGAEYFQH

SEQ ID NO: 12807 - protein, 10 aa, Artificial Sequence
  Description of Artificial Sequence: Synthetic peptide
GKGVHLGFDH

SEQ ID NO: 12808 - protein, 9 aa, Artificial Sequence
  Description of Artificial Sequence: Synthetic peptide
VQLERYFDY

SEQ ID NO: 12809 - protein, 7 aa, Artificial Sequence
  Description of Artificial Sequence: Synthetic peptide
GQLLTGY

SEQ ID NO: 12810 - protein, 7 aa, Artificial Sequence
  Description of Artificial Sequence: Synthetic peptide
GQLLTGY

SEQ ID NO: 12811 - protein, 7 aa, Artificial Sequence
  Description of Artificial Sequence: Synthetic peptide
GQLLTGY

SEQ ID NO: 12812 - protein, 10 aa, Artificial Sequence
  Description of Artificial Sequence: Synthetic peptide
GIAAAGYFDY

SEQ ID NO: 12813 - protein, 7 aa, Artificial Sequence
  Description of Artificial Sequence: Synthetic peptide
GRATFDY

SEQ ID NO: 12814 - protein, 7 aa, Artificial Sequence
  Description of Artificial Sequence: Synthetic peptide
GRATFDY

SEQ ID NO: 12815 - protein, 9 aa, Artificial Sequence
  Description of Artificial Sequence: Synthetic peptide
YNWNDYFDY

SEQ ID NO: 12816 - protein, 8 aa, Artificial Sequence
  Description of Artificial Sequence: Synthetic peptide
YNYGHFDY

SEQ ID NO: 12817 - protein, 8 aa, Artificial Sequence
  Description of Artificial Sequence: Synthetic peptide
YNYGHFDY

SEQ ID NO: 12818 - protein, 10 aa, Artificial Sequence
  Description of Artificial Sequence: Synthetic peptide
FGQGTKLEIK

SEQ ID NO: 12819 - protein, 10 aa, Artificial Sequence
  Description of Artificial Sequence: Synthetic peptide
FGGGTKLELK

SEQ ID NO: 12820 - protein, 10 aa, Artificial Sequence
  Description of Artificial Sequence: Synthetic peptide
FGQGTKLEIK

SEQ ID NO: 12821 - protein, 10 aa, Artificial Sequence
  Description of Artificial Sequence: Synthetic peptide
FGQGTKLEIK

SEQ ID NO: 12822 - protein, 10 aa, Artificial Sequence
  Description of Artificial Sequence: Synthetic peptide
FGQGTKLEIK

SEQ ID NO: 12823 - protein, 10 aa, Artificial Sequence
  Description of Artificial Sequence: Synthetic peptide
FGSGTKLEIK

SEQ ID NO: 12824 - protein, 10 aa, Artificial Sequence
  Description of Artificial Sequence: Synthetic peptide
FGQGTKLEIK

SEQ ID NO: 12825 - protein, 10 aa, Artificial Sequence
  Description of Artificial Sequence: Synthetic peptide
FGAGTKLELK

SEQ ID NO: 12826 - protein, 10 aa, Artificial Sequence
  Description of Artificial Sequence: Synthetic peptide
FGQGTRLEIK

SEQ ID NO: 12827 - protein, 10 aa, Artificial Sequence
  Description of Artificial Sequence: Synthetic peptide
FGQGTRLEIK

SEQ ID NO: 12828 - protein, 10 aa, Artificial Sequence
  Description of Artificial Sequence: Synthetic peptide
FGQGTRLEIK

SEQ ID NO: 12829 - protein, 10 aa, Artificial Sequence
  Description of Artificial Sequence: Synthetic peptide
FGQGTKLEIK

SEQ ID NO: 12830 - protein, 10 aa, Artificial Sequence
  Description of Artificial Sequence: Synthetic peptide
FGPGTKLEIK

SEQ ID NO: 12831 - protein, 10 aa, Artificial Sequence
  Description of Artificial Sequence: Synthetic peptide
FGQGTKLEIK

SEQ ID NO: 12832 - protein, 10 aa, Artificial Sequence
  Description of Artificial Sequence: Synthetic peptide
FGQGTKLEIK

SEQ ID NO: 12833 - protein, 10 aa, Artificial Sequence
  Description of Artificial Sequence: Synthetic peptide
FGQGTKLDIK

SEQ ID NO: 12834 - protein, 10 aa, Artificial Sequence
  Description of Artificial Sequence: Synthetic peptide
FGQGTKLEIK

SEQ ID NO: 12835 - protein, 10 aa, Artificial Sequence
  Description of Artificial Sequence: Synthetic peptide
FGQGTKLEIK

SEQ ID NO: 12836 - protein, 10 aa, Artificial Sequence
  Description of Artificial Sequence: Synthetic peptide
FGQGTKLEIK

SEQ ID NO: 12837 - protein, 10 aa, Artificial Sequence
  Description of Artificial Sequence: Synthetic peptide
FGQGTKLEIK

SEQ ID NO: 12838 - protein, 10 aa, Artificial Sequence
  Description of Artificial Sequence: Synthetic peptide
FGQGTKVEIK

SEQ ID NO: 12839 - protein, 10 aa, Artificial Sequence
  Description of Artificial Sequence: Synthetic peptide
FGQGTKVEIK

SEQ ID NO: 12840 - protein, 10 aa, Artificial Sequence
  Description of Artificial Sequence: Synthetic peptide
FGQGTKVEIK

SEQ ID NO: 12841 - protein, 10 aa, Artificial Sequence
  Description of Artificial Sequence: Synthetic peptide
FGQGTKVEIK

SEQ ID NO: 12842 - protein, 10 aa, Artificial Sequence
  Description of Artificial Sequence: Synthetic peptide
FGQGTKVEIK

SEQ ID NO: 12843 - protein, 10 aa, Artificial Sequence
  Description of Artificial Sequence: Synthetic peptide
FGQGTKVEIK

SEQ ID NO: 12844 - protein, 10 aa, Artificial Sequence
  Description of Artificial Sequence: Synthetic peptide
FGQGTKVEIK

SEQ ID NO: 12845 - protein, 10 aa, Artificial Sequence
  Description of Artificial Sequence: Synthetic peptide
FGQGTKVEIK

SEQ ID NO: 12846 - protein, 10 aa, Artificial Sequence
  Description of Artificial Sequence: Synthetic peptide
FGPGTKVDIK

SEQ ID NO: 12847 - protein, 10 aa, Artificial Sequence
  Description of Artificial Sequence: Synthetic peptide
FGPGTKVDIK

SEQ ID NO: 12848 - protein, 10 aa, Artificial Sequence
  Description of Artificial Sequence: Synthetic peptide
FGPGTKVEIK

SEQ ID NO: 12849 - protein, 10 aa, Artificial Sequence
  Description of Artificial Sequence: Synthetic peptide
FGGGTKVEIK

SEQ ID NO: 12850 - protein, 10 aa, Artificial Sequence
  Description of Artificial Sequence: Synthetic peptide
FGGGTKLEIK

SEQ ID NO: 12851 - protein, 10 aa, Artificial Sequence
  Description of Artificial Sequence: Synthetic peptide
FGGGTKLEIK

SEQ ID NO: 12852 - protein, 10 aa, Artificial Sequence
  Description of Artificial Sequence: Synthetic peptide
FGGGTKVDIK

SEQ ID NO: 12853 - protein, 10 aa, Artificial Sequence
  Description of Artificial Sequence: Synthetic peptide
FGGGTKLEIK

SEQ ID NO: 12854 - protein, 10 aa, Artificial Sequence
  Description of Artificial Sequence: Synthetic peptide
FGGGTKVDIK

SEQ ID NO: 12855 - protein, 10 aa, Artificial Sequence
  Description of Artificial Sequence: Synthetic peptide
FGPGTKVDIK

SEQ ID NO: 12856 - protein, 10 aa, Artificial Sequence
  Description of Artificial Sequence: Synthetic peptide
FGPGTKVEIK

SEQ ID NO: 12857 - protein, 10 aa, Artificial Sequence
  Description of Artificial Sequence: Synthetic peptide
FGPGTKVEIK

SEQ ID NO: 12858 - protein, 10 aa, Artificial Sequence
  Description of Artificial Sequence: Synthetic peptide
FGPGTKVEIK

SEQ ID NO: 12859 - protein, 10 aa, Artificial Sequence
  Description of Artificial Sequence: Synthetic peptide
FGPGTKVDIK

SEQ ID NO: 12860 - protein, 10 aa, Artificial Sequence
  Description of Artificial Sequence: Synthetic peptide
FGPGTKVDIK

SEQ ID NO: 12861 - protein, 10 aa, Artificial Sequence
  Description of Artificial Sequence: Synthetic peptide
FGPGTKVEIK

SEQ ID NO: 12862 - protein, 10 aa, Artificial Sequence
  Description of Artificial Sequence: Synthetic peptide
FGPGTKVEIK

SEQ ID NO: 12863 - protein, 10 aa, Artificial Sequence
  Description of Artificial Sequence: Synthetic peptide
FGPGTKVEIK

SEQ ID NO: 12864 - protein, 10 aa, Artificial Sequence
  Description of Artificial Sequence: Synthetic peptide
FGPGTKVEIK

SEQ ID NO: 12865 - protein, 10 aa, Artificial Sequence
  Description of Artificial Sequence: Synthetic peptide
FGPGTKVEIK

SEQ ID NO: 12866 - protein, 10 aa, Artificial Sequence
  Description of Artificial Sequence: Synthetic peptide
FGPGTKVEIK

SEQ ID NO: 12867 - protein, 10 aa, Artificial Sequence
  Description of Artificial Sequence: Synthetic peptide
FGQGTKVEIK

SEQ ID NO: 12868 - protein, 10 aa, Artificial Sequence
  Description of Artificial Sequence: Synthetic peptide
FGQGTKVEIK

SEQ ID NO: 12869 - protein, 10 aa, Artificial Sequence
  Description of Artificial Sequence: Synthetic peptide
FGQGTKVEIK

SEQ ID NO: 12870 - protein, 10 aa, Artificial Sequence
  Description of Artificial Sequence: Synthetic peptide
FGGGTKVEIK

SEQ ID NO: 12871 - protein, 10 aa, Artificial Sequence
  Description of Artificial Sequence: Synthetic peptide
FGGGTKVEIK

SEQ ID NO: 12872 - protein, 10 aa, Artificial Sequence
  Description of Artificial Sequence: Synthetic peptide
FGGGTKVDIK

SEQ ID NO: 12873 - protein, 10 aa, Artificial Sequence
  Description of Artificial Sequence: Synthetic peptide
FGGGTKLEIK

SEQ ID NO: 12874 - protein, 10 aa, Artificial Sequence
  Description of Artificial Sequence: Synthetic peptide
FGGGTKVEIK

SEQ ID NO: 12875 - protein, 10 aa, Artificial Sequence
  Description of Artificial Sequence: Synthetic peptide
FGGGTKVEIK

SEQ ID NO: 12876 - protein, 10 aa, Artificial Sequence
  Description of Artificial Sequence: Synthetic peptide
FGQGTKLEIK

SEQ ID NO: 12877 - protein, 10 aa, Artificial Sequence
  Description of Artificial Sequence: Synthetic peptide
FGQGTKLEIK

SEQ ID NO: 12878 - protein, 10 aa, Artificial Sequence
  Description of Artificial Sequence: Synthetic peptide
FGGGTKLEIK

SEQ ID NO: 12879 - protein, 10 aa, Artificial Sequence
  Description of Artificial Sequence: Synthetic peptide
FGQGTKVEIK

SEQ ID NO: 12880 - protein, 10 aa, Artificial Sequence
  Description of Artificial Sequence: Synthetic peptide
FGQGTKVDIK

SEQ ID NO: 12881 - protein, 10 aa, Artificial Sequence
  Description of Artificial Sequence: Synthetic peptide
FGQGTKVEIK

SEQ ID NO: 12882 - protein, 10 aa, Artificial Sequence
  Description of Artificial Sequence: Synthetic peptide
FGQGTKVDIK

SEQ ID NO: 12883 - protein, 10 aa, Artificial Sequence
  Description of Artificial Sequence: Synthetic peptide
FGQGTKVDIK

SEQ ID NO: 12884 - protein, 10 aa, Artificial Sequence
  Description of Artificial Sequence: Synthetic peptide
FGPGTKVEIK

SEQ ID NO: 12885 - protein, 10 aa, Artificial Sequence
  Description of Artificial Sequence: Synthetic peptide
FGPGTKVEIK

SEQ ID NO: 12886 - protein, 10 aa, Artificial Sequence
  Description of Artificial Sequence: Synthetic peptide
FGPGTKVEIK

SEQ ID NO: 12887 - protein, 10 aa, Artificial Sequence
  Description of Artificial Sequence: Synthetic peptide
FGQGTRLEIK

SEQ ID NO: 12888 - protein, 10 aa, Artificial Sequence
  Description of Artificial Sequence: Synthetic peptide
FGQGTRLEIK

SEQ ID NO: 12889 - protein, 10 aa, Artificial Sequence
  Description of Artificial Sequence: Synthetic peptide
FGQGTRLEIK

SEQ ID NO: 12890 - protein, 10 aa, Artificial Sequence
  Description of Artificial Sequence: Synthetic peptide
FGQGTKVEIK

SEQ ID NO: 12891 - protein, 10 aa, Artificial Sequence
  Description of Artificial Sequence: Synthetic peptide
FGQGTKVDIK

SEQ ID NO: 12892 - protein, 10 aa, Artificial Sequence
  Description of Artificial Sequence: Synthetic peptide
FGQGTKVDIK

SEQ ID NO: 12893 - protein, 10 aa, Artificial Sequence
  Description of Artificial Sequence: Synthetic peptide
FGQGTKVEIK

SEQ ID NO: 12894 - protein, 10 aa, Artificial Sequence
  Description of Artificial Sequence: Synthetic peptide
FGQGTKVEIK

SEQ ID NO: 12895 - protein, 10 aa, Artificial Sequence
  Description of Artificial Sequence: Synthetic peptide
FGQGTKVEIK

SEQ ID NO: 12896 - protein, 10 aa, Artificial Sequence
  Description of Artificial Sequence: Synthetic peptide
FGQGTKVEIK

SEQ ID NO: 12897 - protein, 10 aa, Artificial Sequence
  Description of Artificial Sequence: Synthetic peptide
FGQGTKVDIK

SEQ ID NO: 12898 - protein, 10 aa, Artificial Sequence
  Description of Artificial Sequence: Synthetic peptide
FGQGTKVEIK

SEQ ID NO: 12899 - protein, 10 aa, Artificial Sequence
  Description of Artificial Sequence: Synthetic peptide
FGQGTKVDIK

SEQ ID NO: 12900 - protein, 10 aa, Artificial Sequence
  Description of Artificial Sequence: Synthetic peptide
FGGGTKVEIK

SEQ ID NO: 12901 - protein, 10 aa, Artificial Sequence
  Description of Artificial Sequence: Synthetic peptide
FGGGTKLEIK

SEQ ID NO: 12902 - protein, 10 aa, Artificial Sequence
  Description of Artificial Sequence: Synthetic peptide
FGGGTKLEIK

SEQ ID NO: 12903 - protein, 10 aa, Artificial Sequence
  Description of Artificial Sequence: Synthetic peptide
FGGGTKVDIK

SEQ ID NO: 12904 - protein, 10 aa, Artificial Sequence
  Description of Artificial Sequence: Synthetic peptide
FGPGTKVDIK

SEQ ID NO: 12905 - protein, 10 aa, Artificial Sequence
  Description of Artificial Sequence: Synthetic peptide
FGPGTKVEIK

SEQ ID NO: 12906 - protein, 10 aa, Artificial Sequence
  Description of Artificial Sequence: Synthetic peptide
FGPGTKVDIK

SEQ ID NO: 12907 - protein, 10 aa, Artificial Sequence
  Description of Artificial Sequence: Synthetic peptide
FGPGTKVEIK

SEQ ID NO: 12908 - protein, 10 aa, Artificial Sequence
  Description of Artificial Sequence: Synthetic peptide
FGPGTKVDIK

SEQ ID NO: 12909 - protein, 10 aa, Artificial Sequence
  Description of Artificial Sequence: Synthetic peptide
FGPGTKVEIK

SEQ ID NO: 12910 - protein, 10 aa, Artificial Sequence
  Description of Artificial Sequence: Synthetic peptide
FGPGTKVEIK

SEQ ID NO: 12911 - protein, 10 aa, Artificial Sequence
  Description of Artificial Sequence: Synthetic peptide
FGPGTKVDIK

SEQ ID NO: 12912 - protein, 10 aa, Artificial Sequence
  Description of Artificial Sequence: Synthetic peptide
FGPGTKVEIK

SEQ ID NO: 12913 - protein, 10 aa, Artificial Sequence
  Description of Artificial Sequence: Synthetic peptide
FGQGTKVEIK

SEQ ID NO: 12914 - protein, 10 aa, Artificial Sequence
  Description of Artificial Sequence: Synthetic peptide
FGQGTKVEIK

SEQ ID NO: 12915 - protein, 10 aa, Artificial Sequence
  Description of Artificial Sequence: Synthetic peptide
FGQGTRLEIK

SEQ ID NO: 12916 - protein, 10 aa, Artificial Sequence
  Description of Artificial Sequence: Synthetic peptide
FGQGTRLEIK

SEQ ID NO: 12917 - protein, 10 aa, Artificial Sequence
  Description of Artificial Sequence: Synthetic peptide
FGQGTKVEIK

SEQ ID NO: 12918 - protein, 10 aa, Artificial Sequence
  Description of Artificial Sequence: Synthetic peptide
FGQGTKVEIK

SEQ ID NO: 12919 - protein, 10 aa, Artificial Sequence
  Description of Artificial Sequence: Synthetic peptide
FGQGTKVEIK

SEQ ID NO: 12920 - protein, 10 aa, Artificial Sequence
  Description of Artificial Sequence: Synthetic peptide
FGQGTKVDIK

SEQ ID NO: 12921 - protein, 10 aa, Artificial Sequence
  Description of Artificial Sequence: Synthetic peptide
FGQGTKVEIK

SEQ ID NO: 12922 - protein, 10 aa, Artificial Sequence
  Description of Artificial Sequence: Synthetic peptide
FGQGTKVEIK

SEQ ID NO: 12923 - protein, 10 aa, Artificial Sequence
  Description of Artificial Sequence: Synthetic peptide
FGGGTKVEIK

SEQ ID NO: 12924 - protein, 10 aa, Artificial Sequence
  Description of Artificial Sequence: Synthetic peptide
FGGGTKVEIK

SEQ ID NO: 12925 - protein, 10 aa, Artificial Sequence
  Description of Artificial Sequence: Synthetic peptide
FGGGTKVEIK

SEQ ID NO: 12926 - protein, 10 aa, Artificial Sequence
  Description of Artificial Sequence: Synthetic peptide
FGGGTKVDIK

SEQ ID NO: 12927 - protein, 10 aa, Artificial Sequence
  Description of Artificial Sequence: Synthetic peptide
FGGGTKVEIK

SEQ ID NO: 12928 - protein, 10 aa, Artificial Sequence
  Description of Artificial Sequence: Synthetic peptide
FGQGTKLEIK

SEQ ID NO: 12929 - protein, 10 aa, Artificial Sequence
  Description of Artificial Sequence: Synthetic peptide
FGPGTKLEIK

SEQ ID NO: 12930 - protein, 10 aa, Artificial Sequence
  Description of Artificial Sequence: Synthetic peptide
FGPGTKLEIK

SEQ ID NO: 12931 - protein, 10 aa, Artificial Sequence
  Description of Artificial Sequence: Synthetic peptide
FGPGTKLEIK

SEQ ID NO: 12932 - protein, 10 aa, Artificial Sequence
  Description of Artificial Sequence: Synthetic peptide
FGGGTKLEIK

SEQ ID NO: 12933 - protein, 10 aa, Artificial Sequence
  Description of Artificial Sequence: Synthetic peptide
FGPGTKLEIK

SEQ ID NO: 12934 - protein, 10 aa, Artificial Sequence
  Description of Artificial Sequence: Synthetic peptide
FGPGTKLEIK

SEQ ID NO: 12935 - protein, 10 aa, Artificial Sequence
  Description of Artificial Sequence: Synthetic peptide
FGPGTKLEIK

SEQ ID NO: 12936 - protein, 10 aa, Artificial Sequence
  Description of Artificial Sequence: Synthetic peptide
FGPGTKLEIK

SEQ ID NO: 12937 - protein, 10 aa, Artificial Sequence
  Description of Artificial Sequence: Synthetic peptide
FGPGTKLEIK

SEQ ID NO: 12938 - protein, 10 aa, Artificial Sequence
  Description of Artificial Sequence: Synthetic peptide
FGGGTKVEIK

SEQ ID NO: 12939 - protein, 10 aa, Artificial Sequence
  Description of Artificial Sequence: Synthetic peptide
FGGGTKVEIK

SEQ ID NO: 12940 - protein, 10 aa, Artificial Sequence
  Description of Artificial Sequence: Synthetic peptide
FGGGTKVEIK

SEQ ID NO: 12941 - protein, 10 aa, Artificial Sequence
  Description of Artificial Sequence: Synthetic peptide
FGGGTKVEIK

SEQ ID NO: 12942 - protein, 10 aa, Artificial Sequence
  Description of Artificial Sequence: Synthetic peptide
FGGGTKVEIK

SEQ ID NO: 12943 - protein, 10 aa, Artificial Sequence
  Description of Artificial Sequence: Synthetic peptide
FGPGTKVDIK

SEQ ID NO: 12944 - protein, 10 aa, Artificial Sequence
  Description of Artificial Sequence: Synthetic peptide
FGPGTKVEIK

SEQ ID NO: 12945 - protein, 10 aa, Artificial Sequence
  Description of Artificial Sequence: Synthetic peptide
FGPGTKVDIK

SEQ ID NO: 12946 - protein, 10 aa, Artificial Sequence
  Description of Artificial Sequence: Synthetic peptide
FGPGTKVDIK

SEQ ID NO: 12947 - protein, 10 aa, Artificial Sequence
  Description of Artificial Sequence: Synthetic peptide
FGPGTKVDIK

SEQ ID NO: 12948 - protein, 10 aa, Artificial Sequence
  Description of Artificial Sequence: Synthetic peptide
FGPGTKVDIK

SEQ ID NO: 12949 - protein, 10 aa, Artificial Sequence
  Description of Artificial Sequence: Synthetic peptide
FGPGTKVEIK

SEQ ID NO: 12950 - protein, 10 aa, Artificial Sequence
  Description of Artificial Sequence: Synthetic peptide
FGPGTKVEIK

SEQ ID NO: 12951 - protein, 10 aa, Artificial Sequence
  Description of Artificial Sequence: Synthetic peptide
FGPGTKVEIK

SEQ ID NO: 12952 - protein, 10 aa, Artificial Sequence
  Description of Artificial Sequence: Synthetic peptide
FGPGTKVEIK

SEQ ID NO: 12953 - protein, 10 aa, Artificial Sequence
  Description of Artificial Sequence: Synthetic peptide
FGPGTKVDIK

SEQ ID NO: 12954 - protein, 10 aa, Artificial Sequence
  Description of Artificial Sequence: Synthetic peptide
FGPGTKVEIK

SEQ ID NO: 12955 - protein, 10 aa, Artificial Sequence
  Description of Artificial Sequence: Synthetic peptide
FGPGTKVEIK

SEQ ID NO: 12956 - protein, 10 aa, Artificial Sequence
  Description of Artificial Sequence: Synthetic peptide
FGPGTKVDIK

SEQ ID NO: 12957 - protein, 10 aa, Artificial Sequence
  Description of Artificial Sequence: Synthetic peptide
FGPGTKVDIK

SEQ ID NO: 12958 - protein, 10 aa, Artificial Sequence
  Description of Artificial Sequence: Synthetic peptide
FGPGTKVDIK

SEQ ID NO: 12959 - protein, 10 aa, Artificial Sequence
  Description of Artificial Sequence: Synthetic peptide
FGPGTKVEIK

SEQ ID NO: 12960 - protein, 10 aa, Artificial Sequence
  Description of Artificial Sequence: Synthetic peptide
FGPGTKVEIK

SEQ ID NO: 12961 - protein, 10 aa, Artificial Sequence
  Description of Artificial Sequence: Synthetic peptide
FGPGTKVEIK

SEQ ID NO: 12962 - protein, 10 aa, Artificial Sequence
  Description of Artificial Sequence: Synthetic peptide
FGPGTKVDIK

SEQ ID NO: 12963 - protein, 10 aa, Artificial Sequence
  Description of Artificial Sequence: Synthetic peptide
FGPGTKVDIK

SEQ ID NO: 12964 - protein, 10 aa, Artificial Sequence
  Description of Artificial Sequence: Synthetic peptide
FGPGTKVDIK

SEQ ID NO: 12965 - protein, 10 aa, Artificial Sequence
  Description of Artificial Sequence: Synthetic peptide
FGGGTKVEIK

SEQ ID NO: 12966 - protein, 10 aa, Artificial Sequence
  Description of Artificial Sequence: Synthetic peptide
FGGGTKVDIK

SEQ ID NO: 12967 - protein, 10 aa, Artificial Sequence
  Description of Artificial Sequence: Synthetic peptide
FGQGTKVEIK

SEQ ID NO: 12968 - protein, 10 aa, Artificial Sequence
  Description of Artificial Sequence: Synthetic peptide
FGQGTKVEIK

SEQ ID NO: 12969 - protein, 10 aa, Artificial Sequence
  Description of Artificial Sequence: Synthetic peptide
FGQGTKLEIK

SEQ ID NO: 12970 - protein, 10 aa, Artificial Sequence
  Description of Artificial Sequence: Synthetic peptide
FGPGTKLEIK

SEQ ID NO: 12971 - protein, 10 aa, Artificial Sequence
  Description of Artificial Sequence: Synthetic peptide
FGQGTRLEIK

SEQ ID NO: 12972 - protein, 10 aa, Artificial Sequence
  Description of Artificial Sequence: Synthetic peptide
FGQGTRLEIK

SEQ ID NO: 12973 - protein, 10 aa, Artificial Sequence
  Description of Artificial Sequence: Synthetic peptide
FGQGTRLEIK

SEQ ID NO: 12974 - protein, 10 aa, Artificial Sequence
  Description of Artificial Sequence: Synthetic peptide
FGQGTRLEIK

SEQ ID NO: 12975 - protein, 10 aa, Artificial Sequence
  Description of Artificial Sequence: Synthetic peptide
FGQGTRLEIK

SEQ ID NO: 12976 - protein, 10 aa, Artificial Sequence
  Description of Artificial Sequence: Synthetic peptide
FGGGTKLTVL

SEQ ID NO: 12977 - protein, 10 aa, Artificial Sequence
  Description of Artificial Sequence: Synthetic peptide
FGGGTKLTVL

SEQ ID NO: 12978 - protein, 10 aa, Artificial Sequence
  Description of Artificial Sequence: Synthetic peptide
FGGGTKLTVL

SEQ ID NO: 12979 - protein, 10 aa, Artificial Sequence
  Description of Artificial Sequence: Synthetic peptide
FGGGTKLTVL

SEQ ID NO: 12980 - protein, 10 aa, Artificial Sequence
  Description of Artificial Sequence: Synthetic peptide
FGGGTKLTVL

SEQ ID NO: 12981 - protein, 10 aa, Artificial Sequence
  Description of Artificial Sequence: Synthetic peptide
FGGGTKLTVL

SEQ ID NO: 12982 - protein, 10 aa, Artificial Sequence
  Description of Artificial Sequence: Synthetic peptide
FGGGTKLTVL

SEQ ID NO: 12983 - protein, 10 aa, Artificial Sequence
  Description of Artificial Sequence: Synthetic peptide
FGGGTKLTVL

SEQ ID NO: 12984 - protein, 10 aa, Artificial Sequence
  Description of Artificial Sequence: Synthetic peptide
FGGGTKLTVL

SEQ ID NO: 12985 - protein, 10 aa, Artificial Sequence
  Description of Artificial Sequence: Synthetic peptide
FGGGTKLTVL

SEQ ID NO: 12986 - protein, 10 aa, Artificial Sequence
  Description of Artificial Sequence: Synthetic peptide
FGGGTKLTVL

SEQ ID NO: 12987 - protein, 10 aa, Artificial Sequence
  Description of Artificial Sequence: Synthetic peptide
FGGGTKLTVL

SEQ ID NO: 12988 - protein, 10 aa, Artificial Sequence
  Description of Artificial Sequence: Synthetic peptide
FGGGTKLTVL

SEQ ID NO: 12989 - protein, 10 aa, Artificial Sequence
  Description of Artificial Sequence: Synthetic peptide
FGGGTKLTVL

SEQ ID NO: 12990 - protein, 10 aa, Artificial Sequence
  Description of Artificial Sequence: Synthetic peptide
FGGGTKLTVL

SEQ ID NO: 12991 - protein, 10 aa, Artificial Sequence
  Description of Artificial Sequence: Synthetic peptide
FGGGTKLTVL

SEQ ID NO: 12992 - protein, 10 aa, Artificial Sequence
  Description of Artificial Sequence: Synthetic peptide
FGGGTKLTVL

SEQ ID NO: 12993 - protein, 10 aa, Artificial Sequence
  Description of Artificial Sequence: Synthetic peptide
FGGGTKLTVL

SEQ ID NO: 12994 - protein, 10 aa, Artificial Sequence
  Description of Artificial Sequence: Synthetic peptide
FGGGTKLTVL

SEQ ID NO: 12995 - protein, 10 aa, Artificial Sequence
  Description of Artificial Sequence: Synthetic peptide
FGGGTKLTVL

SEQ ID NO: 12996 - protein, 10 aa, Artificial Sequence
  Description of Artificial Sequence: Synthetic peptide
FGGGTKLTVL

SEQ ID NO: 12997 - protein, 10 aa, Artificial Sequence
  Description of Artificial Sequence: Synthetic peptide
FGGGTKLTVL

SEQ ID NO: 12998 - protein, 10 aa, Artificial Sequence
  Description of Artificial Sequence: Synthetic peptide
FGGGTKLTVL

SEQ ID NO: 12999 - protein, 10 aa, Artificial Sequence
  Description of Artificial Sequence: Synthetic peptide
FGGGTKLTVL

SEQ ID NO: 13000 - protein, 10 aa, Artificial Sequence
  Description of Artificial Sequence: Synthetic peptide
FGGGTKLTVL

SEQ ID NO: 13001 - protein, 10 aa, Artificial Sequence
  Description of Artificial Sequence: Synthetic peptide
FGGGTKLTVL

SEQ ID NO: 13002 - protein, 10 aa, Artificial Sequence
  Description of Artificial Sequence: Synthetic peptide
FGGGTKLTVL

SEQ ID NO: 13003 - protein, 10 aa, Artificial Sequence
  Description of Artificial Sequence: Synthetic peptide
FGGGTKLTVL

SEQ ID NO: 13004 - protein, 10 aa, Artificial Sequence
  Description of Artificial Sequence: Synthetic peptide
FGGGTKLTVL

SEQ ID NO: 13005 - protein, 10 aa, Artificial Sequence
  Description of Artificial Sequence: Synthetic peptide
FGGGTKLTVL

SEQ ID NO: 13006 - protein, 10 aa, Artificial Sequence
  Description of Artificial Sequence: Synthetic peptide
FGGGTKLTVL

SEQ ID NO: 13007 - protein, 10 aa, Artificial Sequence
  Description of Artificial Sequence: Synthetic peptide
FGGGTKLTVL

SEQ ID NO: 13008 - protein, 10 aa, Artificial Sequence
  Description of Artificial Sequence: Synthetic peptide
FGGGTKLTVL

SEQ ID NO: 13009 - protein, 10 aa, Artificial Sequence
  Description of Artificial Sequence: Synthetic peptide
FGGGTKLTVL

SEQ ID NO: 13010 - protein, 10 aa, Artificial Sequence
  Description of Artificial Sequence: Synthetic peptide
FGGGTKLTVL

SEQ ID NO: 13011 - protein, 10 aa, Artificial Sequence
  Description of Artificial Sequence: Synthetic peptide
FGGGTKLTVL

SEQ ID NO: 13012 - protein, 10 aa, Artificial Sequence
  Description of Artificial Sequence: Synthetic peptide
FGGGTKLTVL

SEQ ID NO: 13013 - protein, 10 aa, Artificial Sequence
  Description of Artificial Sequence: Synthetic peptide
FGGGTKLTVL

SEQ ID NO: 13014 - protein, 10 aa, Artificial Sequence
  Description of Artificial Sequence: Synthetic peptide
FGGGTKLTVL

SEQ ID NO: 13015 - protein, 10 aa, Artificial Sequence
  Description of Artificial Sequence: Synthetic peptide
FGGGTKLTVL

SEQ ID NO: 13016 - protein, 10 aa, Artificial Sequence
  Description of Artificial Sequence: Synthetic peptide
FGGGTKLTVL

SEQ ID NO: 13017 - protein, 10 aa, Artificial Sequence
  Description of Artificial Sequence: Synthetic peptide
FGGGTKLTVL

SEQ ID NO: 13018 - protein, 10 aa, Artificial Sequence
  Description of Artificial Sequence: Synthetic peptide
FGGGTKLTVL

SEQ ID NO: 13019 - protein, 10 aa, Artificial Sequence
  Description of Artificial Sequence: Synthetic peptide
FGGGTKLTVL

SEQ ID NO: 13020 - protein, 10 aa, Artificial Sequence
  Description of Artificial Sequence: Synthetic peptide
FGGGTKLTVL

SEQ ID NO: 13021 - protein, 10 aa, Artificial Sequence
  Description of Artificial Sequence: Synthetic peptide
FGGGTKLTVL

SEQ ID NO: 13022 - protein, 10 aa, Artificial Sequence
  Description of Artificial Sequence: Synthetic peptide
FGGGTKLTVL

SEQ ID NO: 13023 - protein, 10 aa, Artificial Sequence
  Description of Artificial Sequence: Synthetic peptide
FGGGTKLTVL

SEQ ID NO: 13024 - protein, 10 aa, Artificial Sequence
  Description of Artificial Sequence: Synthetic peptide
FGGGTKLTVL

SEQ ID NO: 13025 - protein, 10 aa, Artificial Sequence
  Description of Artificial Sequence: Synthetic peptide
FGGGTKLTVL

SEQ ID NO: 13026 - protein, 10 aa, Artificial Sequence
  Description of Artificial Sequence: Synthetic peptide
FGGGTKLTVL

SEQ ID NO: 13027 - protein, 10 aa, Artificial Sequence
  Description of Artificial Sequence: Synthetic peptide
FGGGTKLTVL

SEQ ID NO: 13028 - protein, 10 aa, Artificial Sequence
  Description of Artificial Sequence: Synthetic peptide
FGGGTKLTVL

SEQ ID NO: 13029 - protein, 10 aa, Artificial Sequence
  Description of Artificial Sequence: Synthetic peptide
FGGGTKLTVL

SEQ ID NO: 13030 - protein, 10 aa, Artificial Sequence
  Description of Artificial Sequence: Synthetic peptide
FGGGTKLTVL

SEQ ID NO: 13031 - protein, 10 aa, Artificial Sequence
  Description of Artificial Sequence: Synthetic peptide
FGGGTKLTVL

SEQ ID NO: 13032 - protein, 10 aa, Artificial Sequence
  Description of Artificial Sequence: Synthetic peptide
FGGGTKLTVL

SEQ ID NO: 13033 - protein, 10 aa, Artificial Sequence
  Description of Artificial Sequence: Synthetic peptide
FGGGTKLTVL

SEQ ID NO: 13034 - protein, 10 aa, Artificial Sequence
  Description of Artificial Sequence: Synthetic peptide
FGGGTKLTVL

SEQ ID NO: 13035 - protein, 10 aa, Artificial Sequence
  Description of Artificial Sequence: Synthetic peptide
FGGGTKLTVL

SEQ ID NO: 13036 - protein, 10 aa, Artificial Sequence
  Description of Artificial Sequence: Synthetic peptide
FGGGTKLTVL

SEQ ID NO: 13037 - protein, 10 aa, Artificial Sequence
  Description of Artificial Sequence: Synthetic peptide
FGGGTKLTVL

SEQ ID NO: 13038 - protein, 10 aa, Artificial Sequence
  Description of Artificial Sequence: Synthetic peptide
FGGGTKLTVL

SEQ ID NO: 13039 - protein, 10 aa, Artificial Sequence
  Description of Artificial Sequence: Synthetic peptide
FGGGTKLTVL

SEQ ID NO: 13040 - protein, 10 aa, Artificial Sequence
  Description of Artificial Sequence: Synthetic peptide
FGGGTKLTVL

SEQ ID NO: 13041 - protein, 10 aa, Artificial Sequence
  Description of Artificial Sequence: Synthetic peptide
FGGGTKLTVL

SEQ ID NO: 13042 - protein, 10 aa, Artificial Sequence
  Description of Artificial Sequence: Synthetic peptide
FGGGTKLTVL

SEQ ID NO: 13043 - protein, 10 aa, Artificial Sequence
  Description of Artificial Sequence: Synthetic peptide
FGGGTKLTVL

SEQ ID NO: 13044 - protein, 10 aa, Artificial Sequence
  Description of Artificial Sequence: Synthetic peptide
FGGGTKLTVL

SEQ ID NO: 13045 - protein, 10 aa, Artificial Sequence
  Description of Artificial Sequence: Synthetic peptide
FGGGTKLTVL

SEQ ID NO: 13046 - protein, 10 aa, Artificial Sequence
  Description of Artificial Sequence: Synthetic peptide
FGGGTKLTVL

SEQ ID NO: 13047 - protein, 10 aa, Artificial Sequence
  Description of Artificial Sequence: Synthetic peptide
FGGGTKLTVL

SEQ ID NO: 13048 - protein, 10 aa, Artificial Sequence
  Description of Artificial Sequence: Synthetic peptide
FGGGTKLTVL

SEQ ID NO: 13049 - protein, 11 aa, Artificial Sequence
  Description of Artificial Sequence: Synthetic peptide
WGQGTLVTVSS

SEQ ID NO: 13050 - protein, 11 aa, Artificial Sequence
  Description of Artificial Sequence: Synthetic peptide
WGQGTLVTVSS

SEQ ID NO: 13051 - protein, 11 aa, Artificial Sequence
  Description of Artificial Sequence: Synthetic peptide
WGQGTLVTVSS

SEQ ID NO: 13052 - protein, 11 aa, Artificial Sequence
  Description of Artificial Sequence: Synthetic peptide
WGQGTRVTVSS

SEQ ID NO: 13053 - protein, 11 aa, Artificial Sequence
  Description of Artificial Sequence: Synthetic peptide
WGQGTMVTVSS

SEQ ID NO: 13054 - protein, 11 aa, Artificial Sequence
  Description of Artificial Sequence: Synthetic peptide
WGQGTSVTVSS

SEQ ID NO: 13055 - protein, 11 aa, Artificial Sequence
  Description of Artificial Sequence: Synthetic peptide
WGQGTTVTVSS

SEQ ID NO: 13056 - protein, 11 aa, Artificial Sequence
  Description of Artificial Sequence: Synthetic peptide
WGQGTTVTVSS

SEQ ID NO: 13057 - protein, 11 aa, Artificial Sequence
  Description of Artificial Sequence: Synthetic peptide
WGQGTTVTVSS

SEQ ID NO: 13058 - protein, 11 aa, Artificial Sequence
  Description of Artificial Sequence: Synthetic peptide
WGQGTTVTVSS

SEQ ID NO: 13059 - protein, 11 aa, Artificial Sequence
  Description of Artificial Sequence: Synthetic peptide
WGQGTTVTVSS

SEQ ID NO: 13060 - protein, 11 aa, Artificial Sequence
  Description of Artificial Sequence: Synthetic peptide
WGQGTTVTVSS

SEQ ID NO: 13061 - protein, 11 aa, Artificial Sequence
  Description of Artificial Sequence: Synthetic peptide
WGQGTTVTVSS

SEQ ID NO: 13062 - protein, 11 aa, Artificial Sequence
  Description of Artificial Sequence: Synthetic peptide
WGQGTTVTVSS

SEQ ID NO: 13063 - protein, 11 aa, Artificial Sequence
  Description of Artificial Sequence: Synthetic peptide
WGQGTTVTVSS

SEQ ID NO: 13064 - protein, 11 aa, Artificial Sequence
  Description of Artificial Sequence: Synthetic peptide
WGQGTTVTVSS

SEQ ID NO: 13065 - protein, 11 aa, Artificial Sequence
  Description of Artificial Sequence: Synthetic peptide
WGQGTTVTVSS

SEQ ID NO: 13066 - protein, 11 aa, Artificial Sequence
  Description of Artificial Sequence: Synthetic peptide
WGQGTTVTVSS

SEQ ID NO: 13067 - protein, 11 aa, Artificial Sequence
  Description of Artificial Sequence: Synthetic peptide
WGQGTTVTVSS

SEQ ID NO: 13068 - protein, 11 aa, Artificial Sequence
  Description of Artificial Sequence: Synthetic peptide
WGQGTTVTVSS

SEQ ID NO: 13069 - protein, 11 aa, Artificial Sequence
  Description of Artificial Sequence: Synthetic peptide
WGQGTTVTVSS

SEQ ID NO: 13070 - protein, 11 aa, Artificial Sequence
  Description of Artificial Sequence: Synthetic peptide
WGQGTTVTVSS

SEQ ID NO: 13071 - protein, 11 aa, Artificial Sequence
  Description of Artificial Sequence: Synthetic peptide
WGQGTTVTVSS

SEQ ID NO: 13072 - protein, 11 aa, Artificial Sequence
  Description of Artificial Sequence: Synthetic peptide
WGQGTTVTVSS

SEQ ID NO: 13073 - protein, 11 aa, Artificial Sequence
  Description of Artificial Sequence: Synthetic peptide
WGQGTLVTVSS

SEQ ID NO: 13074 - protein, 11 aa, Artificial Sequence
  Description of Artificial Sequence: Synthetic peptide
WGQGTLVTVSS

SEQ ID NO: 13075 - protein, 11 aa, Artificial Sequence
  Description of Artificial Sequence: Synthetic peptide
WGQGTLVTVSS

SEQ ID NO: 13076 - protein, 11 aa, Artificial Sequence
  Description of Artificial Sequence: Synthetic peptide
WGQGTLVTVSS

SEQ ID NO: 13077 - protein, 11 aa, Artificial Sequence
  Description of Artificial Sequence: Synthetic peptide
WGQGTLVTVSS

SEQ ID NO: 13078 - protein, 11 aa, Artificial Sequence
  Description of Artificial Sequence: Synthetic peptide
WGQGTLVTVSS

SEQ ID NO: 13079 - protein, 11 aa, Artificial Sequence
  Description of Artificial Sequence: Synthetic peptide
WGQGTTVTVSS

SEQ ID NO: 13080 - protein, 11 aa, Artificial Sequence
  Description of Artificial Sequence: Synthetic peptide
WGQGTTVTVSS

SEQ ID NO: 13081 - protein, 11 aa, Artificial Sequence
  Description of Artificial Sequence: Synthetic peptide
WGQGTTVTVSS

SEQ ID NO: 13082 - protein, 11 aa, Artificial Sequence
  Description of Artificial Sequence: Synthetic peptide
WGQGTTVTVSS

SEQ ID NO: 13083 - protein, 11 aa, Artificial Sequence
  Description of Artificial Sequence: Synthetic peptide
WGQGTTVTVSS

SEQ ID NO: 13084 - protein, 11 aa, Artificial Sequence
  Description of Artificial Sequence: Synthetic peptide
WGQGTTVTVSS

SEQ ID NO: 13085 - protein, 11 aa, Artificial Sequence
  Description of Artificial Sequence: Synthetic peptide
WGQGTTVTVSS

SEQ ID NO: 13086 - protein, 11 aa, Artificial Sequence
  Description of Artificial Sequence: Synthetic peptide
WGQGTTVTVSS

SEQ ID NO: 13087 - protein, 11 aa, Artificial Sequence
  Description of Artificial Sequence: Synthetic peptide
WGQGTTVTVSS

SEQ ID NO: 13088 - protein, 11 aa, Artificial Sequence
  Description of Artificial Sequence: Synthetic peptide
WGQGTTVTVSS

SEQ ID NO: 13089 - protein, 11 aa, Artificial Sequence
  Description of Artificial Sequence: Synthetic peptide
WGQGTTVTVSS

SEQ ID NO: 13090 - protein, 11 aa, Artificial Sequence
  Description of Artificial Sequence: Synthetic peptide
WGQGTTVTVSS

SEQ ID NO: 13091 - protein, 11 aa, Artificial Sequence
  Description of Artificial Sequence: Synthetic peptide
WGQGTTVTVSS

SEQ ID NO: 13092 - protein, 11 aa, Artificial Sequence
  Description of Artificial Sequence: Synthetic peptide
WGQGTTVTVSS

SEQ ID NO: 13093 - protein, 11 aa, Artificial Sequence
  Description of Artificial Sequence: Synthetic peptide
WGQGTTVTVSS

SEQ ID NO: 13094 - protein, 11 aa, Artificial Sequence
  Description of Artificial Sequence: Synthetic peptide
WGQGTTVTVSS

SEQ ID NO: 13095 - protein, 11 aa, Artificial Sequence
  Description of Artificial Sequence: Synthetic peptide
WGQGTTVTVSS

SEQ ID NO: 13096 - protein, 11 aa, Artificial Sequence
  Description of Artificial Sequence: Synthetic peptide
WGQGTTVTVSS

SEQ ID NO: 13097 - protein, 11 aa, Artificial Sequence
  Description of Artificial Sequence: Synthetic peptide
WGQGTTVTVSS

SEQ ID NO: 13098 - protein, 11 aa, Artificial Sequence
  Description of Artificial Sequence: Synthetic peptide
WGQGTTVTVSS

SEQ ID NO: 13099 - protein, 11 aa, Artificial Sequence
  Description of Artificial Sequence: Synthetic peptide
WGQGTTVTVSS

SEQ ID NO: 13100 - protein, 11 aa, Artificial Sequence
  Description of Artificial Sequence: Synthetic peptide
WGQGTTVTVSS

SEQ ID NO: 13101 - protein, 11 aa, Artificial Sequence
  Description of Artificial Sequence: Synthetic peptide
WGQGTTVTVSS

SEQ ID NO: 13102 - protein, 11 aa, Artificial Sequence
  Description of Artificial Sequence: Synthetic peptide
WGQGTTVTVSS

SEQ ID NO: 13103 - protein, 11 aa, Artificial Sequence
  Description of Artificial Sequence: Synthetic peptide
WGQGTTVTVSS

SEQ ID NO: 13104 - protein, 11 aa, Artificial Sequence
  Description of Artificial Sequence: Synthetic peptide
WGQGTTVTVSS

SEQ ID NO: 13105 - protein, 11 aa, Artificial Sequence
  Description of Artificial Sequence: Synthetic peptide
WGQGTTVTVSS

SEQ ID NO: 13106 - protein, 11 aa, Artificial Sequence
  Description of Artificial Sequence: Synthetic peptide
WGQGTTVTVSS

SEQ ID NO: 13107 - protein, 11 aa, Artificial Sequence
  Description of Artificial Sequence: Synthetic peptide
WGQGTTVTVSS

SEQ ID NO: 13108 - protein, 11 aa, Artificial Sequence
  Description of Artificial Sequence: Synthetic peptide
WGLGTTVTVSS

SEQ ID NO: 13109 - protein, 11 aa, Artificial Sequence
  Description of Artificial Sequence: Synthetic peptide
WGQGTTVTVSS

SEQ ID NO: 13110 - protein, 11 aa, Artificial Sequence
  Description of Artificial Sequence: Synthetic peptide
WGQGTTVTVSS

SEQ ID NO: 13111 - protein, 11 aa, Artificial Sequence
  Description of Artificial Sequence: Synthetic peptide
WGPGTTVTVSS

SEQ ID NO: 13112 - protein, 11 aa, Artificial Sequence
  Description of Artificial Sequence: Synthetic peptide
WGQGTTVTVSS

SEQ ID NO: 13113 - protein, 11 aa, Artificial Sequence
  Description of Artificial Sequence: Synthetic peptide
WGLGTTVTVSS

SEQ ID NO: 13114 - protein, 11 aa, Artificial Sequence
  Description of Artificial Sequence: Synthetic peptide
WGLGTTVTVSS

SEQ ID NO: 13115 - protein, 11 aa, Artificial Sequence
  Description of Artificial Sequence: Synthetic peptide
WGQGTTVTVSS

SEQ ID NO: 13116 - protein, 11 aa, Artificial Sequence
  Description of Artificial Sequence: Synthetic peptide
WGQGTTVTVSS

SEQ ID NO: 13117 - protein, 11 aa, Artificial Sequence
  Description of Artificial Sequence: Synthetic peptide
WGQGTTVTVSS

SEQ ID NO: 13118 - protein, 11 aa, Artificial Sequence
  Description of Artificial Sequence: Synthetic peptide
WGQGTTVTVSS

SEQ ID NO: 13119 - protein, 11 aa, Artificial Sequence
  Description of Artificial Sequence: Synthetic peptide
WGPGTTVTVSS

SEQ ID NO: 13120 - protein, 11 aa, Artificial Sequence
  Description of Artificial Sequence: Synthetic peptide
WGPGTTVTVSS

SEQ ID NO: 13121 - protein, 11 aa, Artificial Sequence
  Description of Artificial Sequence: Synthetic peptide
WGLGTTVTVSS

SEQ ID NO: 13122 - protein, 11 aa, Artificial Sequence
  Description of Artificial Sequence: Synthetic peptide
WGLGTTVTVSS

SEQ ID NO: 13123 - protein, 11 aa, Artificial Sequence
  Description of Artificial Sequence: Synthetic peptide
WGLGTTVTVSS

SEQ ID NO: 13124 - protein, 11 aa, Artificial Sequence
  Description of Artificial Sequence: Synthetic peptide
WGQGTTVTVSS

SEQ ID NO: 13125 - protein, 11 aa, Artificial Sequence
  Description of Artificial Sequence: Synthetic peptide
WGQGTTVTVSS

SEQ ID NO: 13126 - protein, 11 aa, Artificial Sequence
  Description of Artificial Sequence: Synthetic peptide
WGQGTTVTVSS

SEQ ID NO: 13127 - protein, 11 aa, Artificial Sequence
  Description of Artificial Sequence: Synthetic peptide
WGQGTTVTVSS

SEQ ID NO: 13128 - protein, 11 aa, Artificial Sequence
  Description of Artificial Sequence: Synthetic peptide
WGQGTTVTVSS

SEQ ID NO: 13129 - protein, 11 aa, Artificial Sequence
  Description of Artificial Sequence: Synthetic peptide
WGQGTTVTVSS

SEQ ID NO: 13130 - protein, 11 aa, Artificial Sequence
  Description of Artificial Sequence: Synthetic peptide
WGQGTTVTVSS

SEQ ID NO: 13131 - protein, 11 aa, Artificial Sequence
  Description of Artificial Sequence: Synthetic peptide
WGQGTTVTVSS

SEQ ID NO: 13132 - protein, 11 aa, Artificial Sequence
  Description of Artificial Sequence: Synthetic peptide
WGQGTTVTVSS

SEQ ID NO: 13133 - protein, 11 aa, Artificial Sequence
  Description of Artificial Sequence: Synthetic peptide
WGQGTTVTVSS

SEQ ID NO: 13134 - protein, 11 aa, Artificial Sequence
  Description of Artificial Sequence: Synthetic peptide
WGQGTTVTVSS

SEQ ID NO: 13135 - protein, 11 aa, Artificial Sequence
  Description of Artificial Sequence: Synthetic peptide
WGQGTTVTVSS

SEQ ID NO: 13136 - protein, 11 aa, Artificial Sequence
  Description of Artificial Sequence: Synthetic peptide
WGQGTTVTVSS

SEQ ID NO: 13137 - protein, 11 aa, Artificial Sequence
  Description of Artificial Sequence: Synthetic peptide
WGQGTTVTVSS

SEQ ID NO: 13138 - protein, 11 aa, Artificial Sequence
  Description of Artificial Sequence: Synthetic peptide
WGQGTTVTVSS

SEQ ID NO: 13139 - protein, 11 aa, Artificial Sequence
  Description of Artificial Sequence: Synthetic peptide
WGQGTTVTVSS

SEQ ID NO: 13140 - protein, 11 aa, Artificial Sequence
  Description of Artificial Sequence: Synthetic peptide
WGQGTLVTVSS

SEQ ID NO: 13141 - protein, 11 aa, Artificial Sequence
  Description of Artificial Sequence: Synthetic peptide
WGQGTLVTVSS

SEQ ID NO: 13142 - protein, 11 aa, Artificial Sequence
  Description of Artificial Sequence: Synthetic peptide
WGQGTLVTVSS

SEQ ID NO: 13143 - protein, 11 aa, Artificial Sequence
  Description of Artificial Sequence: Synthetic peptide
WGQGTLVTVSS

SEQ ID NO: 13144 - protein, 11 aa, Artificial Sequence
  Description of Artificial Sequence: Synthetic peptide
WGQGTLVTVSS

SEQ ID NO: 13145 - protein, 11 aa, Artificial Sequence
  Description of Artificial Sequence: Synthetic peptide
WGQGTTVTVSS

SEQ ID NO: 13146 - protein, 11 aa, Artificial Sequence
  Description of Artificial Sequence: Synthetic peptide
WGQGTTVTVSS

SEQ ID NO: 13147 - protein, 11 aa, Artificial Sequence
  Description of Artificial Sequence: Synthetic peptide
WGQGTLVTVSS

SEQ ID NO: 13148 - protein, 11 aa, Artificial Sequence
  Description of Artificial Sequence: Synthetic peptide
WGQGNLVTVSS

SEQ ID NO: 13149 - protein, 11 aa, Artificial Sequence
  Description of Artificial Sequence: Synthetic peptide
WGQGTLVTVSS

SEQ ID NO: 13150 - protein, 11 aa, Artificial Sequence
  Description of Artificial Sequence: Synthetic peptide
WGQGTLVTVSS

SEQ ID NO: 13151 - protein, 11 aa, Artificial Sequence
  Description of Artificial Sequence: Synthetic peptide
WGQGILVTVSS

SEQ ID NO: 13152 - protein, 11 aa, Artificial Sequence
  Description of Artificial Sequence: Synthetic peptide
WGQGTLVTVSS

SEQ ID NO: 13153 - protein, 11 aa, Artificial Sequence
  Description of Artificial Sequence: Synthetic peptide
WGQGTTVTVSS

SEQ ID NO: 13154 - protein, 11 aa, Artificial Sequence
  Description of Artificial Sequence: Synthetic peptide
WGQGTTVTVSS

SEQ ID NO: 13155 - protein, 11 aa, Artificial Sequence
  Description of Artificial Sequence: Synthetic peptide
WGQGTLVTVSS

SEQ ID NO: 13156 - protein, 11 aa, Artificial Sequence
  Description of Artificial Sequence: Synthetic peptide
WGQGNLVTVSS

SEQ ID NO: 13157 - protein, 11 aa, Artificial Sequence
  Description of Artificial Sequence: Synthetic peptide
WGQGTLVTVSS

SEQ ID NO: 13158 - protein, 11 aa, Artificial Sequence
  Description of Artificial Sequence: Synthetic peptide
WGQGTLVTVSS

SEQ ID NO: 13159 - protein, 11 aa, Artificial Sequence
  Description of Artificial Sequence: Synthetic peptide
WGQGTLVTVSS

SEQ ID NO: 13160 - protein, 11 aa, Artificial Sequence
  Description of Artificial Sequence: Synthetic peptide
WGQGTLVTVSS

SEQ ID NO: 13161 - protein, 11 aa, Artificial Sequence
  Description of Artificial Sequence: Synthetic peptide
WGQGTLVTVSS

SEQ ID NO: 13162 - protein, 11 aa, Artificial Sequence
  Description of Artificial Sequence: Synthetic peptide
WGQGTLVTVSS

SEQ ID NO: 13163 - protein, 11 aa, Artificial Sequence
  Description of Artificial Sequence: Synthetic peptide
WGQGTLVTVSS

SEQ ID NO: 13164 - protein, 11 aa, Artificial Sequence
  Description of Artificial Sequence: Synthetic peptide
WGQGTLVTVSS

SEQ ID NO: 13165 - protein, 11 aa, Artificial Sequence
  Description of Artificial Sequence: Synthetic peptide
WGQGTLVTVSS

SEQ ID NO: 13166 - protein, 11 aa, Artificial Sequence
  Description of Artificial Sequence: Synthetic peptide
WGQGTLVTVSS

SEQ ID NO: 13167 - protein, 11 aa, Artificial Sequence
  Description of Artificial Sequence: Synthetic peptide
WGQGTLVTVSS

SEQ ID NO: 13168 - protein, 11 aa, Artificial Sequence
  Description of Artificial Sequence: Synthetic peptide
WGQGTTVTVSS

SEQ ID NO: 13169 - protein, 11 aa, Artificial Sequence
  Description of Artificial Sequence: Synthetic peptide
WGQGTTVTVSS

SEQ ID NO: 13170 - protein, 11 aa, Artificial Sequence
  Description of Artificial Sequence: Synthetic peptide
WGQGTTVTVSS

SEQ ID NO: 13171 - protein, 11 aa, Artificial Sequence
  Description of Artificial Sequence: Synthetic peptide
WGQGTTVTVSS

SEQ ID NO: 13172 - protein, 11 aa, Artificial Sequence
  Description of Artificial Sequence: Synthetic peptide
WGQGTTVTVSS

SEQ ID NO: 13173 - protein, 11 aa, Artificial Sequence
  Description of Artificial Sequence: Synthetic peptide
WGLGTTVTVSS

SEQ ID NO: 13174 - protein, 11 aa, Artificial Sequence
  Description of Artificial Sequence: Synthetic peptide
WGQGTTVTVSS

SEQ ID NO: 13175 - protein, 11 aa, Artificial Sequence
  Description of Artificial Sequence: Synthetic peptide
WGQGTTVTVSS

SEQ ID NO: 13176 - protein, 11 aa, Artificial Sequence
  Description of Artificial Sequence: Synthetic peptide
WGQGTTVTVSS

SEQ ID NO: 13177 - protein, 11 aa, Artificial Sequence
  Description of Artificial Sequence: Synthetic peptide
WGQGTTVTVSS

SEQ ID NO: 13178 - protein, 11 aa, Artificial Sequence
  Description of Artificial Sequence: Synthetic peptide
WGQGTTVTVSS

SEQ ID NO: 13179 - protein, 11 aa, Artificial Sequence
  Description of Artificial Sequence: Synthetic peptide
WGQGTTVTVSS

SEQ ID NO: 13180 - protein, 11 aa, Artificial Sequence
  Description of Artificial Sequence: Synthetic peptide
WGQGTTVTVSS

SEQ ID NO: 13181 - protein, 11 aa, Artificial Sequence
  Description of Artificial Sequence: Synthetic peptide
WGQGTTVTVSS

SEQ ID NO: 13182 - protein, 11 aa, Artificial Sequence
  Description of Artificial Sequence: Synthetic peptide
WGQGTTVTVSS

SEQ ID NO: 13183 - protein, 11 aa, Artificial Sequence
  Description of Artificial Sequence: Synthetic peptide
WGQGTTVTVSS

SEQ ID NO: 13184 - protein, 11 aa, Artificial Sequence
  Description of Artificial Sequence: Synthetic peptide
WGQGTTVTVSS

SEQ ID NO: 13185 - protein, 11 aa, Artificial Sequence
  Description of Artificial Sequence: Synthetic peptide
WGQGTTVTVSS

SEQ ID NO: 13186 - protein, 11 aa, Artificial Sequence
  Description of Artificial Sequence: Synthetic peptide
WGQGTTVTVSS

SEQ ID NO: 13187 - protein, 11 aa, Artificial Sequence
  Description of Artificial Sequence: Synthetic peptide
WGQGTTVTVSS

SEQ ID NO: 13188 - protein, 11 aa, Artificial Sequence
  Description of Artificial Sequence: Synthetic peptide
WGQGTTVTVSS

SEQ ID NO: 13189 - protein, 11 aa, Artificial Sequence
  Description of Artificial Sequence: Synthetic peptide
WGQGTTVTVSS

SEQ ID NO: 13190 - protein, 11 aa, Artificial Sequence
  Description of Artificial Sequence: Synthetic peptide
WGQGTTVTVSS

SEQ ID NO: 13191 - protein, 11 aa, Artificial Sequence
  Description of Artificial Sequence: Synthetic peptide
WGQGTTVTVSS

SEQ ID NO: 13192 - protein, 11 aa, Artificial Sequence
  Description of Artificial Sequence: Synthetic peptide
WGQGTTVTVSS

SEQ ID NO: 13193 - protein, 11 aa, Artificial Sequence
  Description of Artificial Sequence: Synthetic peptide
WGQGTTVTVSS

SEQ ID NO: 13194 - protein, 11 aa, Artificial Sequence
  Description of Artificial Sequence: Synthetic peptide
WGQGTTVTVSS

SEQ ID NO: 13195 - protein, 11 aa, Artificial Sequence
  Description of Artificial Sequence: Synthetic peptide
WGQGTTVTVSS

SEQ ID NO: 13196 - protein, 11 aa, Artificial Sequence
  Description of Artificial Sequence: Synthetic peptide
WGQGTTVTVSS

SEQ ID NO: 13197 - protein, 11 aa, Artificial Sequence
  Description of Artificial Sequence: Synthetic peptide
WGQGTTVTVSS

SEQ ID NO: 13198 - protein, 11 aa, Artificial Sequence
  Description of Artificial Sequence: Synthetic peptide
WGQGTTVTVSS

SEQ ID NO: 13199 - protein, 11 aa, Artificial Sequence
  Description of Artificial Sequence: Synthetic peptide
WGQGTTVTVSS

SEQ ID NO: 13200 - protein, 11 aa, Artificial Sequence
  Description of Artificial Sequence: Synthetic peptide
WGQGTTVTVSS

SEQ ID NO: 13201 - protein, 11 aa, Artificial Sequence
  Description of Artificial Sequence: Synthetic peptide
WGQGTTVTVSS

SEQ ID NO: 13202 - protein, 11 aa, Artificial Sequence
  Description of Artificial Sequence: Synthetic peptide
WGQGTTVTVSS

SEQ ID NO: 13203 - protein, 11 aa, Artificial Sequence
  Description of Artificial Sequence: Synthetic peptide
WGQGTTVTVSS

SEQ ID NO: 13204 - protein, 11 aa, Artificial Sequence
  Description of Artificial Sequence: Synthetic peptide
WGQGTTVTVSS

SEQ ID NO: 13205 - protein, 11 aa, Artificial Sequence
  Description of Artificial Sequence: Synthetic peptide
WGQGTTVTVSS

SEQ ID NO: 13206 - protein, 11 aa, Artificial Sequence
  Description of Artificial Sequence: Synthetic peptide
WGQGTLVTVSS

SEQ ID NO: 13207 - protein, 11 aa, Artificial Sequence
  Description of Artificial Sequence: Synthetic peptide
WGQGTLVTVSS

SEQ ID NO: 13208 - protein, 11 aa, Artificial Sequence
  Description of Artificial Sequence: Synthetic peptide
WGQGTLVTVSS

SEQ ID NO: 13209 - protein, 11 aa, Artificial Sequence
  Description of Artificial Sequence: Synthetic peptide
WGQGTLVTVSS

SEQ ID NO: 13210 - protein, 11 aa, Artificial Sequence
  Description of Artificial Sequence: Synthetic peptide
WGQGTLVTVSS

SEQ ID NO: 13211 - protein, 11 aa, Artificial Sequence
  Description of Artificial Sequence: Synthetic peptide
WGQGTLVTVSS

SEQ ID NO: 13212 - protein, 11 aa, Artificial Sequence
  Description of Artificial Sequence: Synthetic peptide
WGQGTLVTVSS

SEQ ID NO: 13213 - protein, 11 aa, Artificial Sequence
  Description of Artificial Sequence: Synthetic peptide
WGQGTLVTVSS

SEQ ID NO: 13214 - protein, 11 aa, Artificial Sequence
  Description of Artificial Sequence: Synthetic peptide
WGQGTLVTVSS

SEQ ID NO: 13215 - protein, 11 aa, Artificial Sequence
  Description of Artificial Sequence: Synthetic peptide
WGQGTLVTVSS

SEQ ID NO: 13216 - protein, 11 aa, Artificial Sequence
  Description of Artificial Sequence: Synthetic peptide
WGQGTLVTVSS

SEQ ID NO: 13217 - protein, 11 aa, Artificial Sequence
  Description of Artificial Sequence: Synthetic peptide
WGQGTLVTVSS

SEQ ID NO: 13218 - protein, 11 aa, Artificial Sequence
  Description of Artificial Sequence: Synthetic peptide
WGQGTLVTVSS

SEQ ID NO: 13219 - protein, 11 aa, Artificial Sequence
  Description of Artificial Sequence: Synthetic peptide
WGQGTLVTVSS

SEQ ID NO: 13220 - protein, 11 aa, Artificial Sequence
  Description of Artificial Sequence: Synthetic peptide
WGQGTLVTVSS

SEQ ID NO: 13221 - protein, 11 aa, Artificial Sequence
  Description of Artificial Sequence: Synthetic peptide
WGQGTLVTVSS

SEQ ID NO: 13222 - protein, 11 aa, Artificial Sequence
  Description of Artificial Sequence: Synthetic peptide
WGQGTLVTVSS

SEQ ID NO: 13223 - protein, 11 aa, Artificial Sequence
  Description of Artificial Sequence: Synthetic peptide
WGQGTLVTVSS

SEQ ID NO: 13224 - protein, 11 aa, Artificial Sequence
  Description of Artificial Sequence: Synthetic peptide
WGQGTLVTVSS

SEQ ID NO: 13225 - protein, 11 aa, Artificial Sequence
  Description of Artificial Sequence: Synthetic peptide
WGQGTLVTVSS

SEQ ID NO: 13226 - protein, 11 aa, Artificial Sequence
  Description of Artificial Sequence: Synthetic peptide
WGQGTLVTVSS

SEQ ID NO: 13227 - protein, 11 aa, Artificial Sequence
  Description of Artificial Sequence: Synthetic peptide
WGQGTLVTVSS

SEQ ID NO: 13228 - protein, 11 aa, Artificial Sequence
  Description of Artificial Sequence: Synthetic peptide
WGQGTLVTVSS

SEQ ID NO: 13229 - protein, 11 aa, Artificial Sequence
  Description of Artificial Sequence: Synthetic peptide
WGQGTLVTVSS

SEQ ID NO: 13230 - protein, 11 aa, Artificial Sequence
  Description of Artificial Sequence: Synthetic peptide
WGQGTLVTVSS

SEQ ID NO: 13231 - protein, 11 aa, Artificial Sequence
  Description of Artificial Sequence: Synthetic peptide
WGQGTLVTVSS

SEQ ID NO: 13232 - protein, 11 aa, Artificial Sequence
  Description of Artificial Sequence: Synthetic peptide
WGQGTLVTVSS

SEQ ID NO: 13233 - protein, 11 aa, Artificial Sequence
  Description of Artificial Sequence: Synthetic peptide
WGQGTLVTVSS

SEQ ID NO: 13234 - protein, 11 aa, Artificial Sequence
  Description of Artificial Sequence: Synthetic peptide
WGQGTLVTVSS

SEQ ID NO: 13235 - protein, 11 aa, Artificial Sequence
  Description of Artificial Sequence: Synthetic peptide
WGQGTLVTVSS

SEQ ID NO: 13236 - protein, 11 aa, Artificial Sequence
  Description of Artificial Sequence: Synthetic peptide
WGQGTLVTVSS

SEQ ID NO: 13237 - protein, 11 aa, Artificial Sequence
  Description of Artificial Sequence: Synthetic peptide
WGQGTLVTVSS

SEQ ID NO: 13238 - protein, 11 aa, Artificial Sequence
  Description of Artificial Sequence: Synthetic peptide
WGQGTLVTVSS

SEQ ID NO: 13239 - protein, 11 aa, Artificial Sequence
  Description of Artificial Sequence: Synthetic peptide
WGQGTLVTVSS

SEQ ID NO: 13240 - protein, 11 aa, Artificial Sequence
  Description of Artificial Sequence: Synthetic peptide
WGQGTLVTVSS

SEQ ID NO: 13241 - protein, 11 aa, Artificial Sequence
  Description of Artificial Sequence: Synthetic peptide
WGQGTLVTVSS

SEQ ID NO: 13242 - protein, 11 aa, Artificial Sequence
  Description of Artificial Sequence: Synthetic peptide
WGQGTLVTVSS

SEQ ID NO: 13243 - protein, 11 aa, Artificial Sequence
  Description of Artificial Sequence: Synthetic peptide
WGQGTLVTVSS

SEQ ID NO: 13244 - protein, 11 aa, Artificial Sequence
  Description of Artificial Sequence: Synthetic peptide
WGQGTLVTVSS

SEQ ID NO: 13245 - protein, 11 aa, Artificial Sequence
  Description of Artificial Sequence: Synthetic peptide
WGQGTLVTVSS

SEQ ID NO: 13246 - protein, 11 aa, Artificial Sequence
  Description of Artificial Sequence: Synthetic peptide
WGQGTLVTVSS

SEQ ID NO: 13247 - protein, 11 aa, Artificial Sequence
  Description of Artificial Sequence: Synthetic peptide
WGQGTLVTVSS

SEQ ID NO: 13248 - protein, 11 aa, Artificial Sequence
  Description of Artificial Sequence: Synthetic peptide
WGQGTLVTVSS

SEQ ID NO: 13249 - protein, 11 aa, Artificial Sequence
  Description of Artificial Sequence: Synthetic peptide
WGQGTLVTVSS

SEQ ID NO: 13250 - protein, 11 aa, Artificial Sequence
  Description of Artificial Sequence: Synthetic peptide
WGQGTLVTVSS

SEQ ID NO: 13251 - protein, 11 aa, Artificial Sequence
  Description of Artificial Sequence: Synthetic peptide
WGQGTLVTVSS

SEQ ID NO: 13252 - protein, 11 aa, Artificial Sequence
  Description of Artificial Sequence: Synthetic peptide
WGQGTLVTVSS

SEQ ID NO: 13253 - protein, 11 aa, Artificial Sequence
  Description of Artificial Sequence: Synthetic peptide
WGQGTLVTVSS

SEQ ID NO: 13254 - protein, 11 aa, Artificial Sequence
  Description of Artificial Sequence: Synthetic peptide
WGQGTLVTVSS

SEQ ID NO: 13255 - protein, 11 aa, Artificial Sequence
  Description of Artificial Sequence: Synthetic peptide
WGQGTLVTVSS

SEQ ID NO: 13256 - protein, 11 aa, Artificial Sequence
  Description of Artificial Sequence: Synthetic peptide
WGQGTLVTVSS

SEQ ID NO: 13257 - protein, 11 aa, Artificial Sequence
  Description of Artificial Sequence: Synthetic peptide
WGQGTLVTVSS

SEQ ID NO: 13258 - protein, 11 aa, Artificial Sequence
  Description of Artificial Sequence: Synthetic peptide
WGQGTLVTVSS

SEQ ID NO: 13259 - protein, 11 aa, Artificial Sequence
  Description of Artificial Sequence: Synthetic peptide
WGQGTLVTVSS

SEQ ID NO: 13260 - protein, 11 aa, Artificial Sequence
  Description of Artificial Sequence: Synthetic peptide
WGQGTLVTVSS

SEQ ID NO: 13261 - protein, 11 aa, Artificial Sequence
  Description of Artificial Sequence: Synthetic peptide
WGQGTLVTVSS

SEQ ID NO: 13262 - protein, 11 aa, Artificial Sequence
  Description of Artificial Sequence: Synthetic peptide
WGQGTLVTVSS

SEQ ID NO: 13263 - protein, 11 aa, Artificial Sequence
  Description of Artificial Sequence: Synthetic peptide
WGQGTLVTVSS

SEQ ID NO: 13264 - protein, 11 aa, Artificial Sequence
  Description of Artificial Sequence: Synthetic peptide
WGQGTLVTVSS

SEQ ID NO: 13265 - protein, 11 aa, Artificial Sequence
  Description of Artificial Sequence: Synthetic peptide
WGQGTLVTVSS

SEQ ID NO: 13266 - protein, 11 aa, Artificial Sequence
  Description of Artificial Sequence: Synthetic peptide
WGQGTLVTVSS

SEQ ID NO: 13267 - protein, 11 aa, Artificial Sequence
  Description of Artificial Sequence: Synthetic peptide
WGQGTLVTVSS

SEQ ID NO: 13268 - protein, 11 aa, Artificial Sequence
  Description of Artificial Sequence: Synthetic peptide
WGQGTLVTVSS

SEQ ID NO: 13269 - protein, 11 aa, Artificial Sequence
  Description of Artificial Sequence: Synthetic peptide
WGQGTLVTVSS

SEQ ID NO: 13270 - protein, 11 aa, Artificial Sequence
  Description of Artificial Sequence: Synthetic peptide
WGQGTLVTVSS

SEQ ID NO: 13271 - protein, 11 aa, Artificial Sequence
  Description of Artificial Sequence: Synthetic peptide
WGQGTLVTVSS

SEQ ID NO: 13272 - protein, 11 aa, Artificial Sequence
  Description of Artificial Sequence: Synthetic peptide
WGQGTLVTVSS

SEQ ID NO: 13273 - protein, 11 aa, Artificial Sequence
  Description of Artificial Sequence: Synthetic peptide
WGQGTLVTVSS

SEQ ID NO: 13274 - protein, 11 aa, Artificial Sequence
  Description of Artificial Sequence: Synthetic peptide
WGQGTLVTVSS

SEQ ID NO: 13275 - protein, 11 aa, Artificial Sequence
  Description of Artificial Sequence: Synthetic peptide
WGQGTLVTVSS

SEQ ID NO: 13276 - protein, 23 aa, Artificial Sequence
  Description of Artificial Sequence: Synthetic peptide
DIVMTQSPDSLAVSLGERATINC

SEQ ID NO: 13277 - protein, 23 aa, Artificial Sequence
  Description of Artificial Sequence: Synthetic peptide
ELVMTQSPSSLAVSVGEKITMSC

SEQ ID NO: 13278 - protein, 23 aa, Artificial Sequence
  Description of Artificial Sequence: Synthetic peptide
ELVMTQSPDSLAVSLGERATINC

SEQ ID NO: 13279 - protein, 23 aa, Artificial Sequence
  Description of Artificial Sequence: Synthetic peptide
ELVMTQSPDSLAVSLGERATINC

SEQ ID NO: 13280 - protein, 23 aa, Artificial Sequence
  Description of Artificial Sequence: Synthetic peptide
EIVLTQSPDFQSVTPKEKVTITC

SEQ ID NO: 13281 - protein, 23 aa, Artificial Sequence
  Description of Artificial Sequence: Synthetic peptide
ELVLTQSPAIMSASPGQKVTITC

SEQ ID NO: 13282 - protein, 23 aa, Artificial Sequence
  Description of Artificial Sequence: Synthetic peptide
AIQMTQSPSSLSASVGDRVTITC

SEQ ID NO: 13283 - protein, 23 aa, Artificial Sequence
  Description of Artificial Sequence: Synthetic peptide
ELQMTQSPASLSASVGETVTITC

SEQ ID NO: 13284 - protein, 23 aa, Artificial Sequence
  Description of Artificial Sequence: Synthetic peptide
DIVMTQSPLSLPVTPGEPASISC

SEQ ID NO: 13285 - protein, 23 aa, Artificial Sequence
  Description of Artificial Sequence: Synthetic peptide
ELVMTQSPLSLPVSPGEPASISC

SEQ ID NO: 13286 - protein, 23 aa, Artificial Sequence
  Description of Artificial Sequence: Synthetic peptide
ELVLTQSPLSLPVTPGEPASISC

SEQ ID NO: 13287 - protein, 23 aa, Artificial Sequence
  Description of Artificial Sequence: Synthetic peptide
DIVMTQSPLSLPVTPGEPASISC

SEQ ID NO: 13288 - protein, 23 aa, Artificial Sequence
  Description of Artificial Sequence: Synthetic peptide
ELVMTQSPLSLPVTPGEPASISC

SEQ ID NO: 13289 - protein, 23 aa, Artificial Sequence
  Description of Artificial Sequence: Synthetic peptide
ELVMTQSPLSLPVTPGEPASISC

SEQ ID NO: 13290 - protein, 23 aa, Artificial Sequence
  Description of Artificial Sequence: Synthetic peptide
ELVLTQSPLSLPVTPGEPASISC

SEQ ID NO: 13291 - protein, 23 aa, Artificial Sequence
  Description of Artificial Sequence: Synthetic peptide
ELVMTQSPLSLPVIPGEPASISC

SEQ ID NO: 13292 - protein, 23 aa, Artificial Sequence
  Description of Artificial Sequence: Synthetic peptide
ELVMTQSPLSLPVTPGEPASISC

SEQ ID NO: 13293 - protein, 23 aa, Artificial Sequence
  Description of Artificial Sequence: Synthetic peptide
ELVLTQSPLSLPVTPGEPASISC

SEQ ID NO: 13294 - protein, 23 aa, Artificial Sequence
  Description of Artificial Sequence: Synthetic peptide
ELVLTQSPLSLPVTPGEPASISC

SEQ ID NO: 13295 - protein, 23 aa, Artificial Sequence
  Description of Artificial Sequence: Synthetic peptide
ELVMTQSPLSLPVTPGEPASISC

SEQ ID NO: 13296 - protein, 23 aa, Artificial Sequence
  Description of Artificial Sequence: Synthetic peptide
DIVMTQTPLSLPVTPGEPASISC

SEQ ID NO: 13297 - protein, 23 aa, Artificial Sequence
  Description of Artificial Sequence: Synthetic peptide
ELVMTQTPLSLPVIPGEPASISC

SEQ ID NO: 13298 - protein, 23 aa, Artificial Sequence
  Description of Artificial Sequence: Synthetic peptide
ELVMTQTPLSLPVTPGEPASISC

SEQ ID NO: 13299 - protein, 23 aa, Artificial Sequence
  Description of Artificial Sequence: Synthetic peptide
ELVMTQTPLSLPVTPGEPASISC

SEQ ID NO: 13300 - protein, 23 aa, Artificial Sequence
  Description of Artificial Sequence: Synthetic peptide
ELVMTQTPLSLPVTPGEPASISC

SEQ ID NO: 13301 - protein, 23 aa, Artificial Sequence
  Description of Artificial Sequence: Synthetic peptide
ELVMTQTPLSLPVTPGEPASISC

SEQ ID NO: 13302 - protein, 23 aa, Artificial Sequence
  Description of Artificial Sequence: Synthetic peptide
ELVMTQTPLSLPVTPGEPASISC

SEQ ID NO: 13303 - protein, 23 aa, Artificial Sequence
  Description of Artificial Sequence: Synthetic peptide
DIVMTQTPLSLPVTPGEPASISC

SEQ ID NO: 13304 - protein, 23 aa, Artificial Sequence
  Description of Artificial Sequence: Synthetic peptide
EIVLTQSPGTLSLSPGERATLSC

SEQ ID NO: 13305 - protein, 23 aa, Artificial Sequence
  Description of Artificial Sequence: Synthetic peptide
ELTLTQSPGTLSLSPGERATLSC

SEQ ID NO: 13306 - protein, 23 aa, Artificial Sequence
  Description of Artificial Sequence: Synthetic peptide
ELTLTQSPGTLSLSPGERATLSC

SEQ ID NO: 13307 - protein, 23 aa, Artificial Sequence
  Description of Artificial Sequence: Synthetic peptide
EIVLTQSPGTLSLSPGERATLSC

SEQ ID NO: 13308 - protein, 23 aa, Artificial Sequence
  Description of Artificial Sequence: Synthetic peptide
ELVLTQSPGTLSLSPGERATLSC

SEQ ID NO: 13309 - protein, 23 aa, Artificial Sequence
  Description of Artificial Sequence: Synthetic peptide
ELVLTQSPGTLSLSPGERATLSC

SEQ ID NO: 13310 - protein, 23 aa, Artificial Sequence
  Description of Artificial Sequence: Synthetic peptide
ELTLTQSPGTLSLSPGERATLSC

SEQ ID NO: 13311 - protein, 23 aa, Artificial Sequence
  Description of Artificial Sequence: Synthetic peptide
ELTLTQSPGTLSLSPGERATLSC

SEQ ID NO: 13312 - protein, 23 aa, Artificial Sequence
  Description of Artificial Sequence: Synthetic peptide
ELVMTQSPGTLSLSPGERATLSC

SEQ ID NO: 13313 - protein, 23 aa, Artificial Sequence
  Description of Artificial Sequence: Synthetic peptide
DIVMTQSPLSLPVTPGEPASISC

SEQ ID NO: 13314 - protein, 23 aa, Artificial Sequence
  Description of Artificial Sequence: Synthetic peptide
ELVMTQSPLSLPVTPGEPASISC

SEQ ID NO: 13315 - protein, 23 aa, Artificial Sequence
  Description of Artificial Sequence: Synthetic peptide
ELVLTQSPLSLPVTPGEPASISC

SEQ ID NO: 13316 - protein, 23 aa, Artificial Sequence
  Description of Artificial Sequence: Synthetic peptide
ELVMTQSPLSLPVTPGEPASISC

SEQ ID NO: 13317 - protein, 23 aa, Artificial Sequence
  Description of Artificial Sequence: Synthetic peptide
ELVMTQSPLSLPVTPGEPASISC

SEQ ID NO: 13318 - protein, 23 aa, Artificial Sequence
  Description of Artificial Sequence: Synthetic peptide
ELVMTQSPLSLPVTPGEPASISC

SEQ ID NO: 13319 - protein, 23 aa, Artificial Sequence
  Description of Artificial Sequence: Synthetic peptide
ELVLTQSPLSLPVTPGEPASISC

SEQ ID NO: 13320 - protein, 23 aa, Artificial Sequence
  Description of Artificial Sequence: Synthetic peptide
ELVLTQSPLSLPVTPGEPASISC

SEQ ID NO: 13321 - protein, 23 aa, Artificial Sequence
  Description of Artificial Sequence: Synthetic peptide
ELVLTQSPLSLPVTPGEPASISC

SEQ ID NO: 13322 - protein, 23 aa, Artificial Sequence
  Description of Artificial Sequence: Synthetic peptide
ELVLTQSPLSLPVTPGEPASISC

SEQ ID NO: 13323 - protein, 23 aa, Artificial Sequence
  Description of Artificial Sequence: Synthetic peptide
ELVMTQSPLSLPVTPGEPASISC

SEQ ID NO: 13324 - protein, 23 aa, Artificial Sequence
  Description of Artificial Sequence: Synthetic peptide
ELVLTQSPLSLPVTPGEPASISC

SEQ ID NO: 13325 - protein, 23 aa, Artificial Sequence
  Description of Artificial Sequence: Synthetic peptide
DIQMTQSPSSVSASVGDRVTITC

SEQ ID NO: 13326 - protein, 23 aa, Artificial Sequence
  Description of Artificial Sequence: Synthetic peptide
ELQMTQSPSSVSASVGDRVTITC

SEQ ID NO: 13327 - protein, 23 aa, Artificial Sequence
  Description of Artificial Sequence: Synthetic peptide
ELQMTQSPSSVSASVGDRVTITC

SEQ ID NO: 13328 - protein, 23 aa, Artificial Sequence
  Description of Artificial Sequence: Synthetic peptide
DIVMTQSPLSLPVTPGEPASISC

SEQ ID NO: 13329 - protein, 23 aa, Artificial Sequence
  Description of Artificial Sequence: Synthetic peptide
ELVMTQSPLSLPVTPGEPASISC

SEQ ID NO: 13330 - protein, 23 aa, Artificial Sequence
  Description of Artificial Sequence: Synthetic peptide
ELVLTQSPLSLPVSPGEPASISC

SEQ ID NO: 13331 - protein, 23 aa, Artificial Sequence
  Description of Artificial Sequence: Synthetic peptide
ELVLTQSPLSLPVTPGEPASISC

SEQ ID NO: 13332 - protein, 23 aa, Artificial Sequence
  Description of Artificial Sequence: Synthetic peptide
ELVMTQSPLSLSVTPGEPASISC

SEQ ID NO: 13333 - protein, 23 aa, Artificial Sequence
  Description of Artificial Sequence: Synthetic peptide
ELVMTQSPLSLPVTPGEPASISC

SEQ ID NO: 13334 - protein, 23 aa, Artificial Sequence
  Description of Artificial Sequence: Synthetic peptide
DIVMTQTPLSLPVTPGEPASISC

SEQ ID NO: 13335 - protein, 23 aa, Artificial Sequence
  Description of Artificial Sequence: Synthetic peptide
ELVMTQTPLSLPVSPGEPASISC

SEQ ID NO: 13336 - protein, 23 aa, Artificial Sequence
  Description of Artificial Sequence: Synthetic peptide
ELVMTQTPLSLPVTPGEPASISC

SEQ ID NO: 13337 - protein, 23 aa, Artificial Sequence
  Description of Artificial Sequence: Synthetic peptide
DIQMTQSPSSLSASVGDRVTITC

SEQ ID NO: 13338 - protein, 23 aa, Artificial Sequence
  Description of Artificial Sequence: Synthetic peptide
ELQMTQSPSSLSASVGDRVTITC

SEQ ID NO: 13339 - protein, 23 aa, Artificial Sequence
  Description of Artificial Sequence: Synthetic peptide
ELVMTQSPSSLSASVGDRVTITC

SEQ ID NO: 13340 - protein, 23 aa, Artificial Sequence
  Description of Artificial Sequence: Synthetic peptide
ELVMTQSPSSLSASVGDRVTITC

SEQ ID NO: 13341 - protein, 23 aa, Artificial Sequence
  Description of Artificial Sequence: Synthetic peptide
ELVMTQSPSSLSASVGDRVTITC

SEQ ID NO: 13342 - protein, 23 aa, Artificial Sequence
  Description of Artificial Sequence: Synthetic peptide
DIQMTQSPSSLSASVGDRVTITC

SEQ ID NO: 13343 - protein, 23 aa, Artificial Sequence
  Description of Artificial Sequence: Synthetic peptide
DIQMTQSPSSLSASVGDRVTITC

SEQ ID NO: 13344 - protein, 23 aa, Artificial Sequence
  Description of Artificial Sequence: Synthetic peptide
DIQMTQSPSSLSASVGDRVTITC

SEQ ID NO: 13345 - protein, 23 aa, Artificial Sequence
  Description of Artificial Sequence: Synthetic peptide
DIVMTQTPLSLPVTPGEPASISC

SEQ ID NO: 13346 - protein, 23 aa, Artificial Sequence
  Description of Artificial Sequence: Synthetic peptide
ELVMTQTPLSLPVSPGEPASISC

SEQ ID NO: 13347 - protein, 23 aa, Artificial Sequence
  Description of Artificial Sequence: Synthetic peptide
ELVMTQTPLSLPVTPGEPASISC

SEQ ID NO: 13348 - protein, 23 aa, Artificial Sequence
  Description of Artificial Sequence: Synthetic peptide
DIVMTQSPLSLPVTPGEPASISC

SEQ ID NO: 13349 - protein, 23 aa, Artificial Sequence
  Description of Artificial Sequence: Synthetic peptide
ELVMTQSPLSLPVTPGEPASISC

SEQ ID NO: 13350 - protein, 23 aa, Artificial Sequence
  Description of Artificial Sequence: Synthetic peptide
ELVMTQSPLSLPVSPGEPASISC

SEQ ID NO: 13351 - protein, 23 aa, Artificial Sequence
  Description of Artificial Sequence: Synthetic peptide
ELVLTQSPLSLPVTPGEPASISC

SEQ ID NO: 13352 - protein, 23 aa, Artificial Sequence
  Description of Artificial Sequence: Synthetic peptide
ELVLTQSPLSLPVTPGEPASISC

SEQ ID NO: 13353 - protein, 23 aa, Artificial Sequence
  Description of Artificial Sequence: Synthetic peptide
ELVMTQSPLSLPVTPGEPASISC

SEQ ID NO: 13354 - protein, 23 aa, Artificial Sequence
  Description of Artificial Sequence: Synthetic peptide
ELVMTQSPLSLPVTPGEPASISC

SEQ ID NO: 13355 - protein, 23 aa, Artificial Sequence
  Description of Artificial Sequence: Synthetic peptide
ELVMTQSPLSLPVTPGEPASISC

SEQ ID NO: 13356 - protein, 23 aa, Artificial Sequence
  Description of Artificial Sequence: Synthetic peptide
ELVMTQSPLSLPVTPGEPASISC

SEQ ID NO: 13357 - protein, 23 aa, Artificial Sequence
  Description of Artificial Sequence: Synthetic peptide
ELVMTQSPLSLPVTPGEPASISC

SEQ ID NO: 13358 - protein, 23 aa, Artificial Sequence
  Description of Artificial Sequence: Synthetic peptide
DIVMTQTPLSLPVTPGEPASISC

SEQ ID NO: 13359 - protein, 23 aa, Artificial Sequence
  Description of Artificial Sequence: Synthetic peptide
ELVMTQTPLSLPVIPGEPASISC

SEQ ID NO: 13360 - protein, 23 aa, Artificial Sequence
  Description of Artificial Sequence: Synthetic peptide
ELVMTQTPLSLPVTPGEPASISC

SEQ ID NO: 13361 - protein, 23 aa, Artificial Sequence
  Description of Artificial Sequence: Synthetic peptide
ELVMTQTPLSLPVTPGEPASISC

SEQ ID NO: 13362 - protein, 23 aa, Artificial Sequence
  Description of Artificial Sequence: Synthetic peptide
DIQMTQSPSSLSASVGDRVTITC

SEQ ID NO: 13363 - protein, 23 aa, Artificial Sequence
  Description of Artificial Sequence: Synthetic peptide
ELQMTQSPSSLSASVGDRVTITC

SEQ ID NO: 13364 - protein, 23 aa, Artificial Sequence
  Description of Artificial Sequence: Synthetic peptide
ELQMTQSPSSLSASVGDRVTITC

SEQ ID NO: 13365 - protein, 23 aa, Artificial Sequence
  Description of Artificial Sequence: Synthetic peptide
ELVMTQSPSSLSASVGDRVTITC

SEQ ID NO: 13366 - protein, 23 aa, Artificial Sequence
  Description of Artificial Sequence: Synthetic peptide
ELVMTQSPSSLSASVGDRVTITC

SEQ ID NO: 13367 - protein, 23 aa, Artificial Sequence
  Description of Artificial Sequence: Synthetic peptide
DIQMTQSPSSLSASVGDRVTITC

SEQ ID NO: 13368 - protein, 23 aa, Artificial Sequence
  Description of Artificial Sequence: Synthetic peptide
DIQMTQSPSSLSASVGDRVTITC

SEQ ID NO: 13369 - protein, 23 aa, Artificial Sequence
  Description of Artificial Sequence: Synthetic peptide
DIVMTQTPLSLPVTPGEPASISC

SEQ ID NO: 13370 - protein, 23 aa, Artificial Sequence
  Description of Artificial Sequence: Synthetic peptide
ELVMTQTPLSLPVTPGEPASISC

SEQ ID NO: 13371 - protein, 23 aa, Artificial Sequence
  Description of Artificial Sequence: Synthetic peptide
DIQMTQSPSSLSASVGDRVTITC

SEQ ID NO: 13372 - protein, 23 aa, Artificial Sequence
  Description of Artificial Sequence: Synthetic peptide
ELVMTQSPSSLSASVGDRVTITC

SEQ ID NO: 13373 - protein, 23 aa, Artificial Sequence
  Description of Artificial Sequence: Synthetic peptide
DIVMTQTPLSLSVTPGQPASISC

SEQ ID NO: 13374 - protein, 23 aa, Artificial Sequence
  Description of Artificial Sequence: Synthetic peptide
ELVMTQSPLSLSVTPGQPASISC

SEQ ID NO: 13375 - protein, 23 aa, Artificial Sequence
  Description of Artificial Sequence: Synthetic peptide
DIVMTQSPDSLAVSLGERATINC

SEQ ID NO: 13376 - protein, 23 aa, Artificial Sequence
  Description of Artificial Sequence: Synthetic peptide
ELVMTQSPDSLAVSLGERATINC

SEQ ID NO: 13377 - protein, 23 aa, Artificial Sequence
  Description of Artificial Sequence: Synthetic peptide
ELVMTQSPDSLAVSLGERATINC

SEQ ID NO: 13378 - protein, 23 aa, Artificial Sequence
  Description of Artificial Sequence: Synthetic peptide
ELVMTQSPDSLAVSLGERATINC

SEQ ID NO: 13379 - protein, 23 aa, Artificial Sequence
  Description of Artificial Sequence: Synthetic peptide
DIQMTQSPSSLSASVGDRVTITC

SEQ ID NO: 13380 - protein, 23 aa, Artificial Sequence
  Description of Artificial Sequence: Synthetic peptide
ELVMTQSPSSLSASVGDRVTITC

SEQ ID NO: 13381 - protein, 23 aa, Artificial Sequence
  Description of Artificial Sequence: Synthetic peptide
DIVMTQSPDSLAVSLGERATINC

SEQ ID NO: 13382 - protein, 23 aa, Artificial Sequence
  Description of Artificial Sequence: Synthetic peptide
ELVMTQSPDSLAVSLGERATINC

SEQ ID NO: 13383 - protein, 23 aa, Artificial Sequence
  Description of Artificial Sequence: Synthetic peptide
ELVMTQSPDSLAVSLGERATINC

SEQ ID NO: 13384 - protein, 23 aa, Artificial Sequence
  Description of Artificial Sequence: Synthetic peptide
ELVMTQSPDSLAVSLGERATINC

SEQ ID NO: 13385 - protein, 23 aa, Artificial Sequence
  Description of Artificial Sequence: Synthetic peptide
ELVMTQTPDSLAVSLGERATINC

SEQ ID NO: 13386 - protein, 23 aa, Artificial Sequence
  Description of Artificial Sequence: Synthetic peptide
DIQMTQSPSSLSASVGDRVTITC

SEQ ID NO: 13387 - protein, 23 aa, Artificial Sequence
  Description of Artificial Sequence: Synthetic peptide
ELVMTQSPSSLSASVGDRVTITC

SEQ ID NO: 13388 - protein, 23 aa, Artificial Sequence
  Description of Artificial Sequence: Synthetic peptide
ELQMTQSPSSLSASVGDRVTITC

SEQ ID NO: 13389 - protein, 23 aa, Artificial Sequence
  Description of Artificial Sequence: Synthetic peptide
ELQMTQSPSSLSASVGDRVTITC

SEQ ID NO: 13390 - protein, 23 aa, Artificial Sequence
  Description of Artificial Sequence: Synthetic peptide
ELVMTQSPSSLSASVGDRVTITC

SEQ ID NO: 13391 - protein, 23 aa, Artificial Sequence
  Description of Artificial Sequence: Synthetic peptide
ELVMTQSPSSLSASVGDRVTITC

SEQ ID NO: 13392 - protein, 23 aa, Artificial Sequence
  Description of Artificial Sequence: Synthetic peptide
ELVMTQSPSSLSASVGDRVTITC

SEQ ID NO: 13393 - protein, 23 aa, Artificial Sequence
  Description of Artificial Sequence: Synthetic peptide
ELVMTQSPSSLSASVGDRVTITC

SEQ ID NO: 13394 - protein, 23 aa, Artificial Sequence
  Description of Artificial Sequence: Synthetic peptide
DIQMTQSPSSLSASVGDRVTITC

SEQ ID NO: 13395 - protein, 23 aa, Artificial Sequence
  Description of Artificial Sequence: Synthetic peptide
DIQMTQSPSSLSASVGDRVTITC

SEQ ID NO: 13396 - protein, 23 aa, Artificial Sequence
  Description of Artificial Sequence: Synthetic peptide
DIQMTQSPSSLSASVGDRVTITC

SEQ ID NO: 13397 - protein, 23 aa, Artificial Sequence
  Description of Artificial Sequence: Synthetic peptide
ELQMTQSPSSLSASVGDRVTITC

SEQ ID NO: 13398 - protein, 23 aa, Artificial Sequence
  Description of Artificial Sequence: Synthetic peptide
ELQMTQSPSSLSASVGDRVTITC

SEQ ID NO: 13399 - protein, 23 aa, Artificial Sequence
  Description of Artificial Sequence: Synthetic peptide
ELVMTQSPSSLSASVGDRVTITC

SEQ ID NO: 13400 - protein, 23 aa, Artificial Sequence
  Description of Artificial Sequence: Synthetic peptide
DIQMTQSPSSLSASVGDRVTITC

SEQ ID NO: 13401 - protein, 23 aa, Artificial Sequence
  Description of Artificial Sequence: Synthetic peptide
DIQMTQSPSSLSASVGDRVTITC

SEQ ID NO: 13402 - protein, 23 aa, Artificial Sequence
  Description of Artificial Sequence: Synthetic peptide
ELQMTQSPSSLSASVGDRVTITC

SEQ ID NO: 13403 - protein, 23 aa, Artificial Sequence
  Description of Artificial Sequence: Synthetic peptide
ELVMTQSPSSLSASVGDRVTITC

SEQ ID NO: 13404 - protein, 23 aa, Artificial Sequence
  Description of Artificial Sequence: Synthetic peptide
ELVMTQSPSSLSASVGDRVTITC

SEQ ID NO: 13405 - protein, 23 aa, Artificial Sequence
  Description of Artificial Sequence: Synthetic peptide
ELVMTQSPSSLSASVGDRVTITC

SEQ ID NO: 13406 - protein, 23 aa, Artificial Sequence
  Description of Artificial Sequence: Synthetic peptide
ELVMTQSPSSLSASVGDRVTITC

SEQ ID NO: 13407 - protein, 23 aa, Artificial Sequence
  Description of Artificial Sequence: Synthetic peptide
ELVMTQSPSSLSASVGDRVTITC

SEQ ID NO: 13408 - protein, 23 aa, Artificial Sequence
  Description of Artificial Sequence: Synthetic peptide
ELQMTQSPSSLSASVGDRVTITC

SEQ ID NO: 13409 - protein, 23 aa, Artificial Sequence
  Description of Artificial Sequence: Synthetic peptide
ELQMTQSPSSLSASVGDRVTITC

SEQ ID NO: 13410 - protein, 23 aa, Artificial Sequence
  Description of Artificial Sequence: Synthetic peptide
ELQMTQSPSSLSASVGDRVTITC

SEQ ID NO: 13411 - protein, 23 aa, Artificial Sequence
  Description of Artificial Sequence: Synthetic peptide
ELVMTQSPSSLSASVGDRVTITC

SEQ ID NO: 13412 - protein, 23 aa, Artificial Sequence
  Description of Artificial Sequence: Synthetic peptide
ELQMTQSPSSLSASVGDRVTITC

SEQ ID NO: 13413 - protein, 23 aa, Artificial Sequence
  Description of Artificial Sequence: Synthetic peptide
ELVMTQSPSSLSASVGDRVTITC

SEQ ID NO: 13414 - protein, 23 aa, Artificial Sequence
  Description of Artificial Sequence: Synthetic peptide
ELQMTQSPSSLSASVGDRVTITC

SEQ ID NO: 13415 - protein, 23 aa, Artificial Sequence
  Description of Artificial Sequence: Synthetic peptide
ELVMTQSPSSLSASVGDRVTITC

SEQ ID NO: 13416 - protein, 23 aa, Artificial Sequence
  Description of Artificial Sequence: Synthetic peptide
ELVMTQSPSSLSASVGDRVTITC

SEQ ID NO: 13417 - protein, 23 aa, Artificial Sequence
  Description of Artificial Sequence: Synthetic peptide
ELVMTQSPSSLSASVGDRVTITC

SEQ ID NO: 13418 - protein, 23 aa, Artificial Sequence
  Description of Artificial Sequence: Synthetic peptide
DIQMTQSPSSLSASVGDRVTITC

SEQ ID NO: 13419 - protein, 23 aa, Artificial Sequence
  Description of Artificial Sequence: Synthetic peptide
DIQMTQSPSSLSASVGDRVTITC

SEQ ID NO: 13420 - protein, 23 aa, Artificial Sequence
  Description of Artificial Sequence: Synthetic peptide
DIQMTQSPSSLSASVGDRVTITC

SEQ ID NO: 13421 - protein, 23 aa, Artificial Sequence
  Description of Artificial Sequence: Synthetic peptide
DIQMTQSPSSLSASVGDRVTITC

SEQ ID NO: 13422 - protein, 23 aa, Artificial Sequence
  Description of Artificial Sequence: Synthetic peptide
DIQMTQSPSSLSASVGDRVTITC

SEQ ID NO: 13423 - protein, 23 aa, Artificial Sequence
  Description of Artificial Sequence: Synthetic peptide
DIQMTQSPSSVSASVGDRVTITC

SEQ ID NO: 13424 - protein, 23 aa, Artificial Sequence
  Description of Artificial Sequence: Synthetic peptide
ELQMTQSPSSVSASVGDRVTITC

SEQ ID NO: 13425 - protein, 23 aa, Artificial Sequence
  Description of Artificial Sequence: Synthetic peptide
EIVLTQSPGTLSLSPGERATLSC

SEQ ID NO: 13426 - protein, 23 aa, Artificial Sequence
  Description of Artificial Sequence: Synthetic peptide
ELVLTQSPGTLSLSPGERATLSC

SEQ ID NO: 13427 - protein, 23 aa, Artificial Sequence
  Description of Artificial Sequence: Synthetic peptide
DIQMTQSPSSLSASVGDRVTITC

SEQ ID NO: 13428 - protein, 23 aa, Artificial Sequence
  Description of Artificial Sequence: Synthetic peptide
ELVMTQSPSSLSASVGDRVTITC

SEQ ID NO: 13429 - protein, 23 aa, Artificial Sequence
  Description of Artificial Sequence: Synthetic peptide
DIVMTQSPDSLAVSLGERATINC

SEQ ID NO: 13430 - protein, 23 aa, Artificial Sequence
  Description of Artificial Sequence: Synthetic peptide
ELVMTQSPDSLAVSLGERATINC

SEQ ID NO: 13431 - protein, 23 aa, Artificial Sequence
  Description of Artificial Sequence: Synthetic peptide
DIVMTQSPDSLAVSLGERATINC

SEQ ID NO: 13432 - protein, 23 aa, Artificial Sequence
  Description of Artificial Sequence: Synthetic peptide
DIQMTQSPSSLSASVGDRVTITC

SEQ ID NO: 13433 - protein, 23 aa, Artificial Sequence
  Description of Artificial Sequence: Synthetic peptide
ELVMTQSPDSLSASVGDRVTITC

SEQ ID NO: 13434 - protein, 22 aa, Artificial Sequence
  Description of Artificial Sequence: Synthetic peptide
QSALTQPASVSGSPGQSITISC

SEQ ID NO: 13435 - protein, 22 aa, Artificial Sequence
  Description of Artificial Sequence: Synthetic peptide
ELALTQPPSVSGSPGQSITISC

SEQ ID NO: 13436 - protein, 22 aa, Artificial Sequence
  Description of Artificial Sequence: Synthetic peptide
QSVLTQPPSASGTPGQRVTISC

SEQ ID NO: 13437 - protein, 22 aa, Artificial Sequence
  Description of Artificial Sequence: Synthetic peptide
ELVLTQPPSASGTPGQRITISC

SEQ ID NO: 13438 - protein, 22 aa, Artificial Sequence
  Description of Artificial Sequence: Synthetic peptide
QAGLTQPPSVSKGLRQTATLTC

SEQ ID NO: 13439 - protein, 22 aa, Artificial Sequence
  Description of Artificial Sequence: Synthetic peptide
ELVLTQPPSVSKGLRQTATLTC

SEQ ID NO: 13440 - protein, 22 aa, Artificial Sequence
  Description of Artificial Sequence: Synthetic peptide
ELVLTQPSSVSKDLRQTATLTC

SEQ ID NO: 13441 - protein, 22 aa, Artificial Sequence
  Description of Artificial Sequence: Synthetic peptide
QSALTQPPSASGSPGQSVTISC

SEQ ID NO: 13442 - protein, 22 aa, Artificial Sequence
  Description of Artificial Sequence: Synthetic peptide
ELALTQPASASGSPGQSITISC

SEQ ID NO: 13443 - protein, 22 aa, Artificial Sequence
  Description of Artificial Sequence: Synthetic peptide
QAGLTQPPSVSKGLRQTATLTC

SEQ ID NO: 13444 - protein, 22 aa, Artificial Sequence
  Description of Artificial Sequence: Synthetic peptide
ELVLTQLPSVSKGLRQTATLTC

SEQ ID NO: 13445 - protein, 22 aa, Artificial Sequence
  Description of Artificial Sequence: Synthetic peptide
SYVLTQPPSVSVAPGKTARITC

SEQ ID NO: 13446 - protein, 22 aa, Artificial Sequence
  Description of Artificial Sequence: Synthetic peptide
ELVLTQPPSVSVAPGQTARITC

SEQ ID NO: 13447 - protein, 22 aa, Artificial Sequence
  Description of Artificial Sequence: Synthetic peptide
ELVLTQPPSVSVAPGQTARITC

SEQ ID NO: 13448 - protein, 22 aa, Artificial Sequence
  Description of Artificial Sequence: Synthetic peptide
ELVVTQEPSVSVAPGQTARITC

SEQ ID NO: 13449 - protein, 22 aa, Artificial Sequence
  Description of Artificial Sequence: Synthetic peptide
ELVLTQLPSVSVAPGQTARITC

SEQ ID NO: 13450 - protein, 22 aa, Artificial Sequence
  Description of Artificial Sequence: Synthetic peptide
ELVLTQSSSVSVAPGQTARITC

SEQ ID NO: 13451 - protein, 22 aa, Artificial Sequence
  Description of Artificial Sequence: Synthetic peptide
ELVLTQPPSVSVTPGQTARITC

SEQ ID NO: 13452 - protein, 22 aa, Artificial Sequence
  Description of Artificial Sequence: Synthetic peptide
ELVLTQLPSVSVAPGQTARITC

SEQ ID NO: 13453 - protein, 22 aa, Artificial Sequence
  Description of Artificial Sequence: Synthetic peptide
ELMLTQPPSVSVAPGQTARITC

SEQ ID NO: 13454 - protein, 22 aa, Artificial Sequence
  Description of Artificial Sequence: Synthetic peptide
ELMLTQPHSVSVAPGQTARITC

SEQ ID NO: 13455 - protein, 22 aa, Artificial Sequence
  Description of Artificial Sequence: Synthetic peptide
ELMLTQPHSVSVAPGQTARITC

SEQ ID NO: 13456 - protein, 22 aa, Artificial Sequence
  Description of Artificial Sequence: Synthetic peptide
ELMLTQPHSVSVAPGQTARITC

SEQ ID NO: 13457 - protein, 22 aa, Artificial Sequence
  Description of Artificial Sequence: Synthetic peptide
ELVLTQPPSVSVAPGQTARITC

SEQ ID NO: 13458 - protein, 22 aa, Artificial Sequence
  Description of Artificial Sequence: Synthetic peptide
ELVLTQPPSVSVAPGQTARITC

SEQ ID NO: 13459 - protein, 22 aa, Artificial Sequence
  Description of Artificial Sequence: Synthetic peptide
ELMLTQPHSVSVAPGQTARITC

SEQ ID NO: 13460 - protein, 22 aa, Artificial Sequence
  Description of Artificial Sequence: Synthetic peptide
ELVLTQPASVSVAPGQTARITC

SEQ ID NO: 13461 - protein, 22 aa, Artificial Sequence
  Description of Artificial Sequence: Synthetic peptide
ELVLTQSSSVSVAPGQTARITC

SEQ ID NO: 13462 - protein, 22 aa, Artificial Sequence
  Description of Artificial Sequence: Synthetic peptide
ELMLTQPHSVSVAPGQTARITC

SEQ ID NO: 13463 - protein, 22 aa, Artificial Sequence
  Description of Artificial Sequence: Synthetic peptide
ELALTQPASASVAPGQTARITC

SEQ ID NO: 13464 - protein, 22 aa, Artificial Sequence
  Description of Artificial Sequence: Synthetic peptide
ELVLTQLSSVSVAPGQTARITC

SEQ ID NO: 13465 - protein, 22 aa, Artificial Sequence
  Description of Artificial Sequence: Synthetic peptide
ELVVTQEPSVSVAPGQTARITC

SEQ ID NO: 13466 - protein, 22 aa, Artificial Sequence
  Description of Artificial Sequence: Synthetic peptide
ELMLTQPPSVSVAPGQTARITC

SEQ ID NO: 13467 - protein, 22 aa, Artificial Sequence
  Description of Artificial Sequence: Synthetic peptide
ELVLTQPPSVSVAPGQTARITC

SEQ ID NO: 13468 - protein, 22 aa, Artificial Sequence
  Description of Artificial Sequence: Synthetic peptide
ELVLTQPPSVSVAPGQTARITC

SEQ ID NO: 13469 - protein, 22 aa, Artificial Sequence
  Description of Artificial Sequence: Synthetic peptide
ELVLTQPASVSVAPGQTARITC

SEQ ID NO: 13470 - protein, 22 aa, Artificial Sequence
  Description of Artificial Sequence: Synthetic peptide
ELMLTQPHSVSVAPGQTARITC

SEQ ID NO: 13471 - protein, 22 aa, Artificial Sequence
  Description of Artificial Sequence: Synthetic peptide
ELVLTQSPSVSVAPGQTARITC

SEQ ID NO: 13472 - protein, 22 aa, Artificial Sequence
  Description of Artificial Sequence: Synthetic peptide
ELALTQPPSVSVAPGQTARITC

SEQ ID NO: 13473 - protein, 22 aa, Artificial Sequence
  Description of Artificial Sequence: Synthetic peptide
ELVLTQPPSVSVAPGQTARITC

SEQ ID NO: 13474 - protein, 22 aa, Artificial Sequence
  Description of Artificial Sequence: Synthetic peptide
ELVLTQPPSVSVAPGQTARITC

SEQ ID NO: 13475 - protein, 22 aa, Artificial Sequence
  Description of Artificial Sequence: Synthetic peptide
ELVLTQPPSVSVAPGQTARITC

SEQ ID NO: 13476 - protein, 22 aa, Artificial Sequence
  Description of Artificial Sequence: Synthetic peptide
ELVLTQPASVSVAPGQTARITC

SEQ ID NO: 13477 - protein, 22 aa, Artificial Sequence
  Description of Artificial Sequence: Synthetic peptide
ELALTQPASASVAPGQTARISC

SEQ ID NO: 13478 - protein, 22 aa, Artificial Sequence
  Description of Artificial Sequence: Synthetic peptide
ELVLTQPPSVSVAPGQTARITC

SEQ ID NO: 13479 - protein, 22 aa, Artificial Sequence
  Description of Artificial Sequence: Synthetic peptide
ELVVTQEPSVSVAPGQTARITC

SEQ ID NO: 13480 - protein, 22 aa, Artificial Sequence
  Description of Artificial Sequence: Synthetic peptide
ELVLTQPPSVSVAPGQTARITC

SEQ ID NO: 13481 - protein, 22 aa, Artificial Sequence
  Description of Artificial Sequence: Synthetic peptide
ELVLTQPPSVSVAPGQTARITC

SEQ ID NO: 13482 - protein, 22 aa, Artificial Sequence
  Description of Artificial Sequence: Synthetic peptide
ELVLTQPPSVSVAPGQTARITC

SEQ ID NO: 13483 - protein, 22 aa, Artificial Sequence
  Description of Artificial Sequence: Synthetic peptide
ELVLTQPSSVSVAPGQTARITC

SEQ ID NO: 13484 - protein, 22 aa, Artificial Sequence
  Description of Artificial Sequence: Synthetic peptide
ELVLTQPPSVSVAPGQTARITC

SEQ ID NO: 13485 - protein, 22 aa, Artificial Sequence
  Description of Artificial Sequence: Synthetic peptide
ELVLTQPPSVSVAPGQTARITC

SEQ ID NO: 13486 - protein, 22 aa, Artificial Sequence
  Description of Artificial Sequence: Synthetic peptide
ELMLTQPHSVSVAPGQTARITC

SEQ ID NO: 13487 - protein, 22 aa, Artificial Sequence
  Description of Artificial Sequence: Synthetic peptide
ELVLTQPPSVSVAPGQTARITC

SEQ ID NO: 13488 - protein, 22 aa, Artificial Sequence
  Description of Artificial Sequence: Synthetic peptide
ELALTQPASASVAPGQTARITC

SEQ ID NO: 13489 - protein, 22 aa, Artificial Sequence
  Description of Artificial Sequence: Synthetic peptide
ELVLTQPPSVSVAPGQTARITC

SEQ ID NO: 13490 - protein, 22 aa, Artificial Sequence
  Description of Artificial Sequence: Synthetic peptide
ELVLTQPPSVSVAPGQTARITC

SEQ ID NO: 13491 - protein, 22 aa, Artificial Sequence
  Description of Artificial Sequence: Synthetic peptide
ELVLTQPPSVSVAPGQTARITC

SEQ ID NO: 13492 - protein, 22 aa, Artificial Sequence
  Description of Artificial Sequence: Synthetic peptide
ELVLTQPPSVSVAPGQTARITC

SEQ ID NO: 13493 - protein, 22 aa, Artificial Sequence
  Description of Artificial Sequence: Synthetic peptide
SYVLTQPPSVSVAPGQTARITC

SEQ ID NO: 13494 - protein, 22 aa, Artificial Sequence
  Description of Artificial Sequence: Synthetic peptide
SYVLTQPPSVSVAPGQTARITC

SEQ ID NO: 13495 - protein, 22 aa, Artificial Sequence
  Description of Artificial Sequence: Synthetic peptide
SYVLTQPPSVSVAPGQTARITC

SEQ ID NO: 13496 - protein, 22 aa, Artificial Sequence
  Description of Artificial Sequence: Synthetic peptide
SYVLTQPPSVSVAPGQTARITC

SEQ ID NO: 13497 - protein, 22 aa, Artificial Sequence
  Description of Artificial Sequence: Synthetic peptide
SYVLTQPPSVSVAPGQTARITC

SEQ ID NO: 13498 - protein, 22 aa, Artificial Sequence
  Description of Artificial Sequence: Synthetic peptide
SYVLTQPPSVSVAPGQTARITC

SEQ ID NO: 13499 - protein, 22 aa, Artificial Sequence
  Description of Artificial Sequence: Synthetic peptide
SYVLTQPPSVSVAPGQTARITC

SEQ ID NO: 13500 - protein, 22 aa, Artificial Sequence
  Description of Artificial Sequence: Synthetic peptide
SYVLTQPPSVSVAPGQTARITC

SEQ ID NO: 13501 - protein, 22 aa, Artificial Sequence
  Description of Artificial Sequence: Synthetic peptide
SYVLTQPPSVSVAPGQTARITC

SEQ ID NO: 13502 - protein, 22 aa, Artificial Sequence
  Description of Artificial Sequence: Synthetic peptide
SYVLTQPPSVSVAPGQTARITC

SEQ ID NO: 13503 - protein, 22 aa, Artificial Sequence
  Description of Artificial Sequence: Synthetic peptide
SYVLTQPPSVSVAPGQTARITC

SEQ ID NO: 13504 - protein, 22 aa, Artificial Sequence
  Description of Artificial Sequence: Synthetic peptide
SYVLTQPPSVSVAPGKTARITC

SEQ ID NO: 13505 - protein, 22 aa, Artificial Sequence
  Description of Artificial Sequence: Synthetic peptide
SYVLTQPPSVSVAPGQTARITC

SEQ ID NO: 13506 - protein, 22 aa, Artificial Sequence
  Description of Artificial Sequence: Synthetic peptide
SYVLTQPPSVSVAPGQTARITC

SEQ ID NO: 13507 - protein, 30 aa, Artificial Sequence; identical to SEQ ID NO: 10298
  Description of Artificial Sequence: Synthetic polypeptide

SEQ ID NO: 13508 - protein, 31 aa, Artificial Sequence; identical to SEQ ID NO: 10299
  Description of Artificial Sequence: Synthetic polypeptide

SEQ ID NO: 13509 - protein, 30 aa, Artificial Sequence; identical to SEQ ID NO: 4049
  Description of Artificial Sequence: Synthetic polypeptide

SEQ ID NO: 13510 - protein, 31 aa, Artificial Sequence; identical to SEQ ID NO: 10301
  Description of Artificial Sequence: Synthetic polypeptide

SEQ ID NO: 13511 - protein, 30 aa, Artificial Sequence; identical to SEQ ID NO: 4049
  Description of Artificial Sequence: Synthetic polypeptide

SEQ ID NO: 13512 - protein, 31 aa, Artificial Sequence; identical to SEQ ID NO: 10299
  Description of Artificial Sequence: Synthetic polypeptide

SEQ ID NO: 13513 - protein, 30 aa, Artificial Sequence; identical to SEQ ID NO: 3145
  Description of Artificial Sequence: Synthetic polypeptide

SEQ ID NO: 13514 - protein, 30 aa, Artificial Sequence; identical to SEQ ID NO: 3146
  Description of Artificial Sequence: Synthetic polypeptide

SEQ ID NO: 13515 - protein, 30 aa, Artificial Sequence; identical to SEQ ID NO: 3146
  Description of Artificial Sequence: Synthetic polypeptide

SEQ ID NO: 13516 - protein, 30 aa, Artificial Sequence; identical to SEQ ID NO: 3145
  Description of Artificial Sequence: Synthetic polypeptide

SEQ ID NO: 13517 - protein, 30 aa, Artificial Sequence; identical to SEQ ID NO: 3146
  Description of Artificial Sequence: Synthetic polypeptide

SEQ ID NO: 13518 - protein, 30 aa, Artificial Sequence; identical to SEQ ID NO: 10309
  Description of Artificial Sequence: Synthetic polypeptide

SEQ ID NO: 13519 - protein, 30 aa, Artificial Sequence; identical to SEQ ID NO: 3146
  Description of Artificial Sequence: Synthetic polypeptide

SEQ ID NO: 13520 - protein, 30 aa, Artificial Sequence; identical to SEQ ID NO: 4057
  Description of Artificial Sequence: Synthetic polypeptide

SEQ ID NO: 13521 - protein, 30 aa, Artificial Sequence; identical to SEQ ID NO: 10312
  Description of Artificial Sequence: Synthetic polypeptide

SEQ ID NO: 13522 - protein, 30 aa, Artificial Sequence; identical to SEQ ID NO: 10312
  Description of Artificial Sequence: Synthetic polypeptide

SEQ ID NO: 13523 - protein, 30 aa, Artificial Sequence; identical to SEQ ID NO: 10312
  Description of Artificial Sequence: Synthetic polypeptide

SEQ ID NO: 13524 - protein, 30 aa, Artificial Sequence; identical to SEQ ID NO: 10312
  Description of Artificial Sequence: Synthetic polypeptide

SEQ ID NO: 13525 - protein, 30 aa, Artificial Sequence; identical to SEQ ID NO: 10312
  Description of Artificial Sequence: Synthetic polypeptide

SEQ ID NO: 13526 - protein, 30 aa, Artificial Sequence; identical to SEQ ID NO: 10312
  Description of Artificial Sequence: Synthetic polypeptide

SEQ ID NO: 13527 - protein, 30 aa, Artificial Sequence; identical to SEQ ID NO: 10312
  Description of Artificial Sequence: Synthetic polypeptide

SEQ ID NO: 13528 - protein, 30 aa, Artificial Sequence; identical to SEQ ID NO: 10312
  Description of Artificial Sequence: Synthetic polypeptide

SEQ ID NO: 13529 - protein, 30 aa, Artificial Sequence; identical to SEQ ID NO: 10320
  Description of Artificial Sequence: Synthetic polypeptide

SEQ ID NO: 13530 - protein, 30 aa, Artificial Sequence; identical to SEQ ID NO: 10321
  Description of Artificial Sequence: Synthetic polypeptide

SEQ ID NO: 13531 - protein, 30 aa, Artificial Sequence; identical to SEQ ID NO: 779
  Description of Artificial Sequence: Synthetic polypeptide

SEQ ID NO: 13532 - protein, 30 aa, Artificial Sequence; identical to SEQ ID NO: 779
  Description of Artificial Sequence: Synthetic polypeptide

SEQ ID NO: 13533 - protein, 30 aa, Artificial Sequence; identical to SEQ ID NO: 779
  Description of Artificial Sequence: Synthetic polypeptide

SEQ ID NO: 13534 - protein, 30 aa, Artificial Sequence; identical to SEQ ID NO: 779
  Description of Artificial Sequence: Synthetic polypeptide

SEQ ID NO: 13535 - protein, 30 aa, Artificial Sequence; identical to SEQ ID NO: 779
  Description of Artificial Sequence: Synthetic polypeptide

SEQ ID NO: 13536 - protein, 30 aa, Artificial Sequence; identical to SEQ ID NO: 779
  Description of Artificial Sequence: Synthetic polypeptide

SEQ ID NO: 13537 - protein, 30 aa, Artificial Sequence; identical to SEQ ID NO: 853
  Description of Artificial Sequence: Synthetic polypeptide

SEQ ID NO: 13538 - protein, 30 aa, Artificial Sequence; identical to SEQ ID NO: 10329
  Description of Artificial Sequence: Synthetic polypeptide

SEQ ID NO: 13539 - protein, 30 aa, Artificial Sequence; identical to SEQ ID NO: 784
  Description of Artificial Sequence: Synthetic polypeptide

SEQ ID NO: 13540 - protein, 30 aa, Artificial Sequence; identical to SEQ ID NO: 4057
  Description of Artificial Sequence: Synthetic polypeptide

SEQ ID NO: 13541 - protein, 30 aa, Artificial Sequence; identical to SEQ ID NO: 10312
  Description of Artificial Sequence: Synthetic polypeptide

SEQ ID NO: 13542 - protein, 30 aa, Artificial Sequence; identical to SEQ ID NO: 10312
  Description of Artificial Sequence: Synthetic polypeptide

SEQ ID NO: 13543 - protein, 30 aa, Artificial Sequence; identical to SEQ ID NO: 10321
  Description of Artificial Sequence: Synthetic polypeptide

SEQ ID NO: 13544 - protein, 30 aa, Artificial Sequence; identical to SEQ ID NO: 10312
  Description of Artificial Sequence: Synthetic polypeptide

SEQ ID NO: 13545 - protein, 30 aa, Artificial Sequence; identical to SEQ ID NO: 10312
  Description of Artificial Sequence: Synthetic polypeptide

SEQ ID NO: 13546 - protein, 30 aa, Artificial Sequence; identical to SEQ ID NO: 10312
  Description of Artificial Sequence: Synthetic polypeptide

SEQ ID NO: 13547 - protein, 30 aa, Artificial Sequence; identical to SEQ ID NO: 10312
  Description of Artificial Sequence: Synthetic polypeptide

SEQ ID NO: 13548 - protein, 30 aa, Artificial Sequence; identical to SEQ ID NO: 10312
  Description of Artificial Sequence: Synthetic polypeptide

SEQ ID NO: 13549 - protein, 30 aa, Artificial Sequence; identical to SEQ ID NO: 10312
  Description of Artificial Sequence: Synthetic polypeptide

SEQ ID NO: 13550 - protein, 30 aa, Artificial Sequence; identical to SEQ ID NO: 779
  Description of Artificial Sequence: Synthetic polypeptide

SEQ ID NO: 13551 - protein, 30 aa, Artificial Sequence; identical to SEQ ID NO: 779
  Description of Artificial Sequence: Synthetic polypeptide

SEQ ID NO: 13552 - protein, 30 aa, Artificial Sequence; identical to SEQ ID NO: 779
  Description of Artificial Sequence: Synthetic polypeptide

SEQ ID NO: 13553 - protein, 30 aa, Artificial Sequence; identical to SEQ ID NO: 10344
  Description of Artificial Sequence: Synthetic polypeptide

SEQ ID NO: 13554 - protein, 30 aa, Artificial Sequence; identical to SEQ ID NO: 779
  Description of Artificial Sequence: Synthetic polypeptide

SEQ ID NO: 13555 - protein, 30 aa, Artificial Sequence; identical to SEQ ID NO: 779
  Description of Artificial Sequence: Synthetic polypeptide

SEQ ID NO: 13556 - protein, 30 aa, Artificial Sequence; identical to SEQ ID NO: 779
  Description of Artificial Sequence: Synthetic polypeptide

SEQ ID NO: 13557 - protein, 30 aa, Artificial Sequence; identical to SEQ ID NO: 779
  Description of Artificial Sequence: Synthetic polypeptide

SEQ ID NO: 13558 - protein, 30 aa, Artificial Sequence; identical to SEQ ID NO: 10349
  Description of Artificial Sequence: Synthetic polypeptide

SEQ ID NO: 13559 - protein, 30 aa, Artificial Sequence; identical to SEQ ID NO: 779
  Description of Artificial Sequence: Synthetic polypeptide

SEQ ID NO: 13560 - protein, 30 aa, Artificial Sequence; identical to SEQ ID NO: 779
  Description of Artificial Sequence: Synthetic polypeptide

SEQ ID NO: 13561 - protein, 30 aa, Artificial Sequence; identical to SEQ ID NO: 779
  Description of Artificial Sequence: Synthetic polypeptide

SEQ ID NO: 13562 - protein, 30 aa, Artificial Sequence; identical to SEQ ID NO: 779
  Description of Artificial Sequence: Synthetic polypeptide

SEQ ID NO: 13563 - protein, 30 aa, Artificial Sequence; identical to SEQ ID NO: 858
  Description of Artificial Sequence: Synthetic polypeptide

SEQ ID NO: 13564 - protein, 30 aa, Artificial Sequence; identical to SEQ ID NO: 3164
  Description of Artificial Sequence: Synthetic polypeptide

SEQ ID NO: 13565 - protein, 30 aa, Artificial Sequence; identical to SEQ ID NO: 10356
  Description of Artificial Sequence: Synthetic polypeptide

SEQ ID NO: 13566 - protein, 30 aa, Artificial Sequence; identical to SEQ ID NO: 3164
  Description of Artificial Sequence: Synthetic polypeptide

SEQ ID NO: 13567 - protein, 30 aa, Artificial Sequence; identical to SEQ ID NO: 10358
  Description of Artificial Sequence: Synthetic polypeptide

SEQ ID NO: 13568 - protein, 30 aa, Artificial Sequence; identical to SEQ ID NO: 10358
  Description of Artificial Sequence: Synthetic polypeptide

SEQ ID NO: 13569 - protein, 30 aa, Artificial Sequence; identical to SEQ ID NO: 10358
  Description of Artificial Sequence: Synthetic polypeptide

SEQ ID NO: 13570 - protein, 30 aa, Artificial Sequence; identical to SEQ ID NO: 10358
  Description of Artificial Sequence: Synthetic polypeptide

SEQ ID NO: 13571 - protein, 30 aa, Artificial Sequence; identical to SEQ ID NO: 3164
  Description of Artificial Sequence: Synthetic polypeptide

SEQ ID NO: 13572 - protein, 30 aa, Artificial Sequence; identical to SEQ ID NO: 3164
  Description of Artificial Sequence: Synthetic polypeptide

SEQ ID NO: 13573 - protein, 30 aa, Artificial Sequence; identical to SEQ ID NO: 10358
  Description of Artificial Sequence: Synthetic polypeptide

SEQ ID NO: 13574 - protein, 30 aa, Artificial Sequence; identical to SEQ ID NO: 10358
  Description of Artificial Sequence: Synthetic polypeptide

SEQ ID NO: 13575 - protein, 30 aa, Artificial Sequence; identical to SEQ ID NO: 3164
  Description of Artificial Sequence: Synthetic polypeptide

SEQ ID NO: 13576 - protein, 30 aa, Artificial Sequence; identical to SEQ ID NO: 10358
  Description of Artificial Sequence: Synthetic polypeptide

SEQ ID NO: 13577 - protein, 30 aa, Artificial Sequence; identical to SEQ ID NO: 3164
  Description of Artificial Sequence: Synthetic polypeptide

SEQ ID NO: 13578 - protein, 30 aa, Artificial Sequence; identical to SEQ ID NO: 3164
  Description of Artificial Sequence: Synthetic polypeptide

SEQ ID NO: 13579 - protein, 30 aa, Artificial Sequence; identical to SEQ ID NO: 3164
  Description of Artificial Sequence: Synthetic polypeptide

SEQ ID NO: 13580 - protein, 30 aa, Artificial Sequence; identical to SEQ ID NO: 3164
  Description of Artificial Sequence: Synthetic polypeptide

SEQ ID NO: 13581 - protein, 30 aa, Artificial Sequence; identical to SEQ ID NO: 3164
  Description of Artificial Sequence: Synthetic polypeptide

SEQ ID NO: 13582 - protein, 30 aa, Artificial Sequence; identical to SEQ ID NO: 779
  Description of Artificial Sequence: Synthetic polypeptide

SEQ ID NO: 13583 - protein, 30 aa, Artificial Sequence; identical to SEQ ID NO: 779
  Description of Artificial Sequence: Synthetic polypeptide

SEQ ID NO: 13584 - protein, 30 aa, Artificial Sequence; identical to SEQ ID NO: 853
  Description of Artificial Sequence: Synthetic polypeptide

SEQ ID NO: 13585 - protein, 30 aa, Artificial Sequence; identical to SEQ ID NO: 784
  Description of Artificial Sequence: Synthetic polypeptide

SEQ ID NO: 13586 - protein, 30 aa, Artificial Sequence; identical to SEQ ID NO: 784
  Description of Artificial Sequence: Synthetic polypeptide

SEQ ID NO: 13587 - protein, 30 aa, Artificial Sequence; identical to SEQ ID NO: 3145
  Description of Artificial Sequence: Synthetic polypeptide

SEQ ID NO: 13588 - protein, 30 aa, Artificial Sequence; identical to SEQ ID NO: 3146
  Description of Artificial Sequence: Synthetic polypeptide

SEQ ID NO: 13589 - protein, 30 aa, Artificial Sequence; identical to SEQ ID NO: 3146
  Description of Artificial Sequence: Synthetic polypeptide

SEQ ID NO: 13590 - protein, 30 aa, Artificial Sequence; identical to SEQ ID NO: 3146
  Description of Artificial Sequence: Synthetic polypeptide

SEQ ID NO: 13591 - protein, 30 aa, Artificial Sequence; identical to SEQ ID NO: 3146
  Description of Artificial Sequence: Synthetic polypeptide

SEQ ID NO: 13592 - protein, 30 aa, Artificial Sequence; identical to SEQ ID NO: 3146
  Description of Artificial Sequence: Synthetic polypeptide

SEQ ID NO: 13593 - protein, 30 aa, Artificial Sequence; identical to SEQ ID NO: 832
  Description of Artificial Sequence: Synthetic polypeptide

SEQ ID NO: 13594 - protein, 30 aa, Artificial Sequence; identical to SEQ ID NO: 787
  Description of Artificial Sequence: Synthetic polypeptide

SEQ ID NO: 13595 - protein, 30 aa, Artificial Sequence; identical to SEQ ID NO: 853
  Description of Artificial Sequence: Synthetic polypeptide

SEQ ID NO: 13596 - protein, 30 aa, Artificial Sequence; identical to SEQ ID NO: 784
  Description of Artificial Sequence: Synthetic polypeptide

SEQ ID NO: 13597 - protein, 30 aa, Artificial Sequence; identical to SEQ ID NO: 784
  Description of Artificial Sequence: Synthetic polypeptide

SEQ ID NO: 13598 - protein, 30 aa, Artificial Sequence; identical to SEQ ID NO: 851
  Description of Artificial Sequence: Synthetic polypeptide

SEQ ID NO: 13599 - protein, 30 aa, Artificial Sequence; identical to SEQ ID NO: 3160
  Description of Artificial Sequence: Synthetic polypeptide

SEQ ID NO: 13600 - protein, 30 aa, Artificial Sequence; identical to SEQ ID NO: 3160
  Description of Artificial Sequence: Synthetic polypeptide

SEQ ID NO: 13601 - protein, 30 aa, Artificial Sequence; identical to SEQ ID NO: 3160
  Description of Artificial Sequence: Synthetic polypeptide

SEQ ID NO: 13602 - protein, 30 aa, Artificial Sequence; identical to SEQ ID NO: 852
  Description of Artificial Sequence: Synthetic polypeptide

SEQ ID NO: 13603 - protein, 30 aa, Artificial Sequence; identical to SEQ ID NO: 5230
  Description of Artificial Sequence: Synthetic polypeptide

SEQ ID NO: 13604 - protein, 30 aa, Artificial Sequence; identical to SEQ ID NO: 10395
  Description of Artificial Sequence: Synthetic polypeptide

SEQ ID NO: 13605 - protein, 30 aa, Artificial Sequence; identical to SEQ ID NO: 10396
  Description of Artificial Sequence: Synthetic polypeptide

SEQ ID NO: 13606 - protein, 30 aa, Artificial Sequence; identical to SEQ ID NO: 10397
  Description of Artificial Sequence: Synthetic polypeptide

SEQ ID NO: 13607 - protein, 30 aa, Artificial Sequence; identical to SEQ ID NO: 830
  Description of Artificial Sequence: Synthetic polypeptide

SEQ ID NO: 13608 - protein, 30 aa, Artificial Sequence; identical to SEQ ID NO: 10399
  Description of Artificial Sequence: Synthetic polypeptide

SEQ ID NO: 13609 - protein, 30 aa, Artificial Sequence; identical to SEQ ID NO: 10400
  Description of Artificial Sequence: Synthetic polypeptide

SEQ ID NO: 13610 - protein, 30 aa, Artificial Sequence; identical to SEQ ID NO: 10399
  Description of Artificial Sequence: Synthetic polypeptide

SEQ ID NO: 13611 - protein, 30 aa, Artificial Sequence; identical to SEQ ID NO: 779
  Description of Artificial Sequence: Synthetic polypeptide

SEQ ID NO: 13612 - protein, 30 aa, Artificial Sequence; identical to SEQ ID NO: 787
  Description of Artificial Sequence: Synthetic polypeptide

SEQ ID NO: 13613 - protein, 30 aa, Artificial Sequence; identical to SEQ ID NO: 851
  Description of Artificial Sequence: Synthetic polypeptide

SEQ ID NO: 13614 - protein, 30 aa, Artificial Sequence; identical to SEQ ID NO: 10405
  Description of Artificial Sequence: Synthetic polypeptide

SEQ ID NO: 13615 - protein, 30 aa, Artificial Sequence; identical to SEQ ID NO: 842
  Description of Artificial Sequence: Synthetic polypeptide

SEQ ID NO: 13616 - protein, 30 aa, Artificial Sequence; identical to SEQ ID NO: 10407
  Description of Artificial Sequence: Synthetic polypeptide

SEQ ID NO: 13617 - protein, 30 aa, Artificial Sequence; identical to SEQ ID NO: 10407
  Description of Artificial Sequence: Synthetic polypeptide

SEQ ID NO: 13618 - protein, 30 aa, Artificial Sequence; identical to SEQ ID NO: 10409
  Description of Artificial Sequence: Synthetic polypeptide

SEQ ID NO: 13619 - protein, 30 aa, Artificial Sequence; identical to SEQ ID NO: 3162
  Description of Artificial Sequence: Synthetic polypeptide

SEQ ID NO: 13620 - protein, 30 aa, Artificial Sequence; identical to SEQ ID NO: 3162
  Description of Artificial Sequence: Synthetic polypeptide

SEQ ID NO: 13621 - protein, 30 aa, Artificial Sequence; identical to SEQ ID NO: 3162
  Description of Artificial Sequence: Synthetic polypeptide

SEQ ID NO: 13622 - protein, 30 aa, Artificial Sequence; identical to SEQ ID NO: 844
  Description of Artificial Sequence: Synthetic polypeptide

SEQ ID NO: 13623 - protein, 30 aa, Artificial Sequence; identical to SEQ ID NO: 845
  Description of Artificial Sequence: Synthetic polypeptide

SEQ ID NO: 13624 - protein, 30 aa, Artificial Sequence; identical to SEQ ID NO: 844
  Description of Artificial Sequence: Synthetic polypeptide

SEQ ID NO: 13625 - protein, 30 aa, Artificial Sequence; identical to SEQ ID NO: 845
  Description of Artificial Sequence: Synthetic polypeptide

SEQ ID NO: 13626 - protein, 30 aa, Artificial Sequence; identical to SEQ ID NO: 779
  Description of Artificial Sequence: Synthetic polypeptide

SEQ ID NO: 13627 - protein, 30 aa, Artificial Sequence; identical to SEQ ID NO: 779
  Description of Artificial Sequence: Synthetic polypeptide

SEQ ID NO: 13628 - protein, 30 aa, Artificial Sequence; identical to SEQ ID NO: 779
  Description of Artificial Sequence: Synthetic polypeptide

SEQ ID NO: 13629 - protein, 30 aa, Artificial Sequence; identical to SEQ ID NO: 858
  Description of Artificial Sequence: Synthetic polypeptide

SEQ ID NO: 13630 - protein, 30 aa, Artificial Sequence; identical to SEQ ID NO: 10421
  Description of Artificial Sequence: Synthetic polypeptide

SEQ ID NO: 13631 - protein, 30 aa, Artificial Sequence; identical to SEQ ID NO: 3164
  Description of Artificial Sequence: Synthetic polypeptide

SEQ ID NO: 13632 - protein, 30 aa, Artificial Sequence; identical to SEQ ID NO: 10356
  Description of Artificial Sequence: Synthetic polypeptide

SEQ ID NO: 13633 - protein, 30 aa, Artificial Sequence; identical to SEQ ID NO: 3164
  Description of Artificial Sequence: Synthetic polypeptide

SEQ ID NO: 13634 - protein, 30 aa, Artificial Sequence; identical to SEQ ID NO: 10356
  Description of Artificial Sequence: Synthetic polypeptide

SEQ ID NO: 13635 - protein, 30 aa, Artificial Sequence; identical to SEQ ID NO: 859
  Description of Artificial Sequence: Synthetic polypeptide

SEQ ID NO: 13636 - protein, 30 aa, Artificial Sequence; identical to SEQ ID NO: 832
  Description of Artificial Sequence: Synthetic polypeptide

SEQ ID NO: 13637 - protein, 30 aa, Artificial Sequence; identical to SEQ ID NO: 787
  Description of Artificial Sequence: Synthetic polypeptide

SEQ ID NO: 13638 - protein, 30 aa, Artificial Sequence; identical to SEQ ID NO: 779
  Description of Artificial Sequence: Synthetic polypeptide

SEQ ID NO: 13639 - protein, 30 aa, Artificial Sequence; identical to SEQ ID NO: 787
  Description of Artificial Sequence: Synthetic polypeptide

SEQ ID NO: 13640 - protein, 30 aa, Artificial Sequence; identical to SEQ ID NO: 787
  Description of Artificial Sequence: Synthetic polypeptide

SEQ ID NO: 13641 - protein, 30 aa, Artificial Sequence; identical to SEQ ID NO: 779
  Description of Artificial Sequence: Synthetic polypeptide

SEQ ID NO: 13642 - protein, 30 aa, Artificial Sequence; identical to SEQ ID NO: 787
  Description of Artificial Sequence: Synthetic polypeptide

SEQ ID NO: 13643 - protein, 30 aa, Artificial Sequence; identical to SEQ ID NO: 779
  Description of Artificial Sequence: Synthetic polypeptide

SEQ ID NO: 13644 - protein, 30 aa, Artificial Sequence; identical to SEQ ID NO: 779
  Description of Artificial Sequence: Synthetic polypeptide

SEQ ID NO: 13645 - protein, 30 aa, Artificial Sequence; identical to SEQ ID NO: 779
  Description of Artificial Sequence: Synthetic polypeptide

SEQ ID NO: 13646 - protein, 30 aa, Artificial Sequence; identical to SEQ ID NO: 787
  Description of Artificial Sequence: Synthetic polypeptide

SEQ ID NO: 13647 - protein, 30 aa, Artificial Sequence; identical to SEQ ID NO: 779
  Description of Artificial Sequence: Synthetic polypeptide

SEQ ID NO: 13648 - protein, 30 aa, Artificial Sequence; identical to SEQ ID NO: 787
  Description of Artificial Sequence: Synthetic polypeptide

SEQ ID NO: 13649 - protein, 30 aa, Artificial Sequence; identical to SEQ ID NO: 779
  Description of Artificial Sequence: Synthetic polypeptide

SEQ ID NO: 13650 - protein, 30 aa, Artificial Sequence; identical to SEQ ID NO: 779
  Description of Artificial Sequence: Synthetic polypeptide

SEQ ID NO: 13651 - protein, 30 aa, Artificial Sequence; identical to SEQ ID NO: 787
  Description of Artificial Sequence: Synthetic polypeptide

SEQ ID NO: 13652 - protein, 30 aa, Artificial Sequence; identical to SEQ ID NO: 779
  Description of Artificial Sequence: Synthetic polypeptide

SEQ ID NO: 13653 - protein, 30 aa, Artificial Sequence; identical to SEQ ID NO: 833
  Description of Artificial Sequence: Synthetic polypeptide

SEQ ID NO: 13654 - protein, 30 aa, Artificial Sequence; identical to SEQ ID NO: 833
  Description of Artificial Sequence: Synthetic polypeptide

SEQ ID NO: 13655 - protein, 30 aa, Artificial Sequence; identical to SEQ ID NO: 833
  Description of Artificial Sequence: Synthetic polypeptide

SEQ ID NO: 13656 - protein, 30 aa, Artificial Sequence; identical to SEQ ID NO: 833
  Description of Artificial Sequence: Synthetic polypeptide

SEQ ID NO: 13657 - protein, 30 aa, Artificial Sequence; identical to SEQ ID NO: 832
  Description of Artificial Sequence: Synthetic polypeptide

SEQ ID NO: 13658 - protein, 30 aa, Artificial Sequence; identical to SEQ ID NO: 833
  Description of Artificial Sequence: Synthetic polypeptide

SEQ ID NO: 13659 - protein, 30 aa, Artificial Sequence; identical to SEQ ID NO: 833
  Description of Artificial Sequence: Synthetic polypeptide

SEQ ID NO: 13660 - protein, 30 aa, Artificial Sequence; identical to SEQ ID NO: 851
  Description of Artificial Sequence: Synthetic polypeptide

SEQ ID NO: 13661 - protein, 30 aa, Artificial Sequence; identical to SEQ ID NO: 10452
  Description of Artificial Sequence: Synthetic polypeptide

SEQ ID NO: 13662 - protein, 30 aa, Artificial Sequence; identical to SEQ ID NO: 10453
  Description of Artificial Sequence: Synthetic polypeptide

SEQ ID NO: 13663 - protein, 30 aa, Artificial Sequence; identical to SEQ ID NO: 10454
  Description of Artificial Sequence: Synthetic polypeptide

SEQ ID NO: 13664 - protein, 30 aa, Artificial Sequence; identical to SEQ ID NO: 779
  Description of Artificial Sequence: Synthetic polypeptide

SEQ ID NO: 13665 - protein, 30 aa, Artificial Sequence; identical to SEQ ID NO: 779
  Description of Artificial Sequence: Synthetic polypeptide

SEQ ID NO: 13666 - protein, 30 aa, Artificial Sequence; identical to SEQ ID NO: 779
  Description of Artificial Sequence: Synthetic polypeptide

SEQ ID NO: 13667 - protein, 30 aa, Artificial Sequence; identical to SEQ ID NO: 779
  Description of Artificial Sequence: Synthetic polypeptide

SEQ ID NO: 13668 - protein, 30 aa, Artificial Sequence; identical to SEQ ID NO: 779
  Description of Artificial Sequence: Synthetic polypeptide

SEQ ID NO: 13669 - protein, 30 aa, Artificial Sequence; identical to SEQ ID NO: 779
  Description of Artificial Sequence: Synthetic polypeptide

SEQ ID NO: 13670 - protein, 30 aa, Artificial Sequence; identical to SEQ ID NO: 779
  Description of Artificial Sequence: Synthetic polypeptide

SEQ ID NO: 13671 - protein, 30 aa, Artificial Sequence; identical to SEQ ID NO: 779
  Description of Artificial Sequence: Synthetic polypeptide

SEQ ID NO: 13672 - protein, 30 aa, Artificial Sequence; identical to SEQ ID NO: 779
  Description of Artificial Sequence: Synthetic polypeptide

SEQ ID NO: 13673 - protein, 30 aa, Artificial Sequence; identical to SEQ ID NO: 779
  Description of Artificial Sequence: Synthetic polypeptide

SEQ ID NO: 13674 - protein, 30 aa, Artificial Sequence; identical to SEQ ID NO: 779
  Description of Artificial Sequence: Synthetic polypeptide

SEQ ID NO: 13675 - protein, 30 aa, Artificial Sequence; identical to SEQ ID NO: 779
  Description of Artificial Sequence: Synthetic polypeptide

SEQ ID NO: 13676 - protein, 30 aa, Artificial Sequence; identical to SEQ ID NO: 10467
  Description of Artificial Sequence: Synthetic polypeptide

SEQ ID NO: 13677 - protein, 30 aa, Artificial Sequence; identical to SEQ ID NO: 779
  Description of Artificial Sequence: Synthetic polypeptide

SEQ ID NO: 13678 - protein, 30 aa, Artificial Sequence; identical to SEQ ID NO: 779
  Description of Artificial Sequence: Synthetic polypeptide

SEQ ID NO: 13679 - protein, 30 aa, Artificial Sequence; identical to SEQ ID NO: 779
  Description of Artificial Sequence: Synthetic polypeptide

SEQ ID NO: 13680 - protein, 30 aa, Artificial Sequence; identical to SEQ ID NO: 10471
  Description of Artificial Sequence: Synthetic polypeptide

SEQ ID NO: 13681 - protein, 30 aa, Artificial Sequence; identical to SEQ ID NO: 10467
  Description of Artificial Sequence: Synthetic polypeptide

SEQ ID NO: 13682 - protein, 30 aa, Artificial Sequence; identical to SEQ ID NO: 779
  Description of Artificial Sequence: Synthetic polypeptide

SEQ ID NO: 13683 - protein, 30 aa, Artificial Sequence; identical to SEQ ID NO: 10467
  Description of Artificial Sequence: Synthetic polypeptide

SEQ ID NO: 13684 - protein, 30 aa, Artificial Sequence; identical to SEQ ID NO: 779
  Description of Artificial Sequence: Synthetic polypeptide

SEQ ID NO: 13685 - protein, 30 aa, Artificial Sequence; identical to SEQ ID NO: 10476
  Description of Artificial Sequence: Synthetic polypeptide

SEQ ID NO: 13686 - protein, 30 aa, Artificial Sequence; identical to SEQ ID NO: 779
  Description of Artificial Sequence: Synthetic polypeptide

SEQ ID NO: 13687 - protein, 30 aa, Artificial Sequence; identical to SEQ ID NO: 779
  Description of Artificial Sequence: Synthetic polypeptide

SEQ ID NO: 13688 - protein, 30 aa, Artificial Sequence; identical to SEQ ID NO: 779
  Description of Artificial Sequence: Synthetic polypeptide

SEQ ID NO: 13689 - protein, 30 aa, Artificial Sequence; identical to SEQ ID NO: 10467
  Description of Artificial Sequence: Synthetic polypeptide

SEQ ID NO: 13690 - protein, 30 aa, Artificial Sequence; identical to SEQ ID NO: 779
  Description of Artificial Sequence: Synthetic polypeptide

SEQ ID NO: 13691 - protein, 30 aa, Artificial Sequence; identical to SEQ ID NO: 779
  Description of Artificial Sequence: Synthetic polypeptide

SEQ ID NO: 13692 - protein, 30 aa, Artificial Sequence; identical to SEQ ID NO: 10467
  Description of Artificial Sequence: Synthetic polypeptide

SEQ ID NO: 13693 - protein, 30 aa, Artificial Sequence; identical to SEQ ID NO: 779
  Description of Artificial Sequence: Synthetic polypeptide

SEQ ID NO: 13694 - protein, 30 aa, Artificial Sequence; identical to SEQ ID NO: 779
  Description of Artificial Sequence: Synthetic polypeptide

SEQ ID NO: 13695 - protein, 30 aa, Artificial Sequence; identical to SEQ ID NO: 779
  Description of Artificial Sequence: Synthetic polypeptide

SEQ ID NO: 13696 - protein, 30 aa, Artificial Sequence; identical to SEQ ID NO: 779
  Description of Artificial Sequence: Synthetic polypeptide

SEQ ID NO: 13697 - protein, 30 aa, Artificial Sequence; identical to SEQ ID NO: 779
  Description of Artificial Sequence: Synthetic polypeptide

SEQ ID NO: 13698 - protein, 30 aa, Artificial Sequence; identical to SEQ ID NO: 779
  Description of Artificial Sequence: Synthetic polypeptide

SEQ ID NO: 13699 - protein, 30 aa, Artificial Sequence; identical to SEQ ID NO: 779
  Description of Artificial Sequence: Synthetic polypeptide

SEQ ID NO: 13700 - protein, 30 aa, Artificial Sequence; identical to SEQ ID NO: 779
  Description of Artificial Sequence: Synthetic polypeptide

SEQ ID NO: 13701 - protein, 30 aa, Artificial Sequence; identical to SEQ ID NO: 779
  Description of Artificial Sequence: Synthetic polypeptide

SEQ ID NO: 13702 - protein, 30 aa, Artificial Sequence; identical to SEQ ID NO: 779
  Description of Artificial Sequence: Synthetic polypeptide

SEQ ID NO: 13703 - protein, 30 aa, Artificial Sequence; identical to SEQ ID NO: 779
  Description of Artificial Sequence: Synthetic polypeptide

SEQ ID NO: 13704 - protein, 30 aa, Artificial Sequence; identical to SEQ ID NO: 787
  Description of Artificial Sequence: Synthetic polypeptide

SEQ ID NO: 13705 - protein, 30 aa, Artificial Sequence; identical to SEQ ID NO: 779
  Description of Artificial Sequence: Synthetic polypeptide

SEQ ID NO: 13706 - protein, 30 aa, Artificial Sequence; identical to SEQ ID NO: 779
  Description of Artificial Sequence: Synthetic polypeptide

SEQ ID NO: 13707 - protein, 30 aa, Artificial Sequence; identical to SEQ ID NO: 779
  Description of Artificial Sequence: Synthetic polypeptide

SEQ ID NO: 13708 - protein, 30 aa, Artificial Sequence; identical to SEQ ID NO: 784
  Description of Artificial Sequence: Synthetic polypeptide

SEQ ID NO: 13709 - protein, 30 aa, Artificial Sequence; identical to SEQ ID NO: 779
  Description of Artificial Sequence: Synthetic polypeptide

SEQ ID NO: 13710 - protein, 30 aa, Artificial Sequence; identical to SEQ ID NO: 779
  Description of Artificial Sequence: Synthetic polypeptide

SEQ ID NO: 13711 - protein, 30 aa, Artificial Sequence; identical to SEQ ID NO: 779
  Description of Artificial Sequence: Synthetic polypeptide

SEQ ID NO: 13712 - protein, 30 aa, Artificial Sequence; identical to SEQ ID NO: 779
  Description of Artificial Sequence: Synthetic polypeptide

SEQ ID NO: 13713 - protein, 30 aa, Artificial Sequence; identical to SEQ ID NO: 779
  Description of Artificial Sequence: Synthetic polypeptide

SEQ ID NO: 13714 - protein, 30 aa, Artificial Sequence; identical to SEQ ID NO: 779
  Description of Artificial Sequence: Synthetic polypeptide

SEQ ID NO: 13715 - protein, 30 aa, Artificial Sequence; identical to SEQ ID NO: 779
  Description of Artificial Sequence: Synthetic polypeptide

SEQ ID NO: 13716 - protein, 30 aa, Artificial Sequence; identical to SEQ ID NO: 779
  Description of Artificial Sequence: Synthetic polypeptide

SEQ ID NO: 13717 - protein, 30 aa, Artificial Sequence; identical to SEQ ID NO: 779
  Description of Artificial Sequence: Synthetic polypeptide

SEQ ID NO: 13718 - protein, 30 aa, Artificial Sequence; identical to SEQ ID NO: 779
  Description of Artificial Sequence: Synthetic polypeptide

SEQ ID NO: 13719 - protein, 30 aa, Artificial Sequence; identical to SEQ ID NO: 779
  Description of Artificial Sequence: Synthetic polypeptide

SEQ ID NO: 13720 - protein, 30 aa, Artificial Sequence; identical to SEQ ID NO: 779
  Description of Artificial Sequence: Synthetic polypeptide

SEQ ID NO: 13721 - protein, 30 aa, Artificial Sequence; identical to SEQ ID NO: 779
  Description of Artificial Sequence: Synthetic polypeptide

SEQ ID NO: 13722 - protein, 30 aa, Artificial Sequence; identical to SEQ ID NO: 779
  Description of Artificial Sequence: Synthetic polypeptide

SEQ ID NO: 13723 - protein, 30 aa, Artificial Sequence; identical to SEQ ID NO: 779
  Description of Artificial Sequence: Synthetic polypeptide

SEQ ID NO: 13724 - protein, 30 aa, Artificial Sequence; identical to SEQ ID NO: 853
  Description of Artificial Sequence: Synthetic polypeptide

SEQ ID NO: 13725 - protein, 30 aa, Artificial Sequence; identical to SEQ ID NO: 784
  Description of Artificial Sequence: Synthetic polypeptide

SEQ ID NO: 13726 - protein, 30 aa, Artificial Sequence; identical to SEQ ID NO: 853
  Description of Artificial Sequence: Synthetic polypeptide

SEQ ID NO: 13727 - protein, 30 aa, Artificial Sequence; identical to SEQ ID NO: 853
  Description of Artificial Sequence: Synthetic polypeptide

SEQ ID NO: 13728 - protein, 30 aa, Artificial Sequence; identical to SEQ ID NO: 3145
  Description of Artificial Sequence: Synthetic polypeptide

SEQ ID NO: 13729 - protein, 30 aa, Artificial Sequence; identical to SEQ ID NO: 3146
  Description of Artificial Sequence: Synthetic polypeptide

SEQ ID NO: 13730 - protein, 30 aa, Artificial Sequence; identical to SEQ ID NO: 3146
  Description of Artificial Sequence: Synthetic polypeptide

SEQ ID NO: 13731 - protein, 30 aa, Artificial Sequence; identical to SEQ ID NO: 856
  Description of Artificial Sequence: Synthetic polypeptide

SEQ ID NO: 13732 - protein, 30 aa, Artificial Sequence; identical to SEQ ID NO: 787
  Description of Artificial Sequence: Synthetic polypeptide

SEQ ID NO: 13733 - protein, 30 aa, Artificial Sequence; identical to SEQ ID NO: 856
  Description of Artificial Sequence: Synthetic polypeptide

SEQ ID NO: 13734 - protein, 17 aa, Artificial Sequence
  Description of Artificial Sequence: Synthetic peptide
KSSQSVLYSSNNKNYLA

SEQ ID NO: 13735 - protein, 17 aa, Artificial Sequence
  Description of Artificial Sequence: Synthetic peptide
KSSQSLLYSSNQKNYLA

SEQ ID NO: 13736 - protein, 17 aa, Artificial Sequence
  Description of Artificial Sequence: Synthetic peptide
KSSQSVLYSSNNKNYLA

SEQ ID NO: 13737 - protein, 17 aa, Artificial Sequence
  Description of Artificial Sequence: Synthetic peptide
KSSQSVLYSSNNKNYLA

SEQ ID NO: 13738 - protein, 11 aa, Artificial Sequence
  Description of Artificial Sequence: Synthetic peptide
RASQSIGSSLH

SEQ ID NO: 13739 - protein, 10 aa, Artificial Sequence
  Description of Artificial Sequence: Synthetic peptide
SASSNVNYIH

SEQ ID NO: 13740 - protein, 11 aa, Artificial Sequence
  Description of Artificial Sequence: Synthetic peptide
RASQGIRNDLG

SEQ ID NO: 13741 - protein, 11 aa, Artificial Sequence
  Description of Artificial Sequence: Synthetic peptide
RASGNIHNYLA

SEQ ID NO: 13742 - protein, 16 aa, Artificial Sequence
  Description of Artificial Sequence: Synthetic peptide
RSSQSLLHSNGYNYLD

SEQ ID NO: 13743 - protein, 16 aa, Artificial Sequence
  Description of Artificial Sequence: Synthetic peptide
RSSQSLLYSNGYNYVD

SEQ ID NO: 13744 - protein, 16 aa, Artificial Sequence
  Description of Artificial Sequence: Synthetic peptide
RSSQSLLHRNGYNYLD

SEQ ID NO: 13745 - protein, 16 aa, Artificial Sequence
  Description of Artificial Sequence: Synthetic peptide
RSSQSLLHSNGYNYLD

SEQ ID NO: 13746 - protein, 16 aa, Artificial Sequence
  Description of Artificial Sequence: Synthetic peptide
RSSQSLLYSNGYHYLD

SEQ ID NO: 13747 - protein, 16 aa, Artificial Sequence
  Description of Artificial Sequence: Synthetic peptide
RSSQRLLFSNGYHYLD

SEQ ID NO: 13748 - protein, 16 aa, Artificial Sequence
  Description of Artificial Sequence: Synthetic peptide
RSSQSLLYSNGYNYLD

SEQ ID NO: 13749 - protein, 16 aa, Artificial Sequence
  Description of Artificial Sequence: Synthetic peptide
RSSQSLLYSNGYNYLD

SEQ ID NO: 13750 - protein, 16 aa, Artificial Sequence
  Description of Artificial Sequence: Synthetic peptide
RSSQSLLHSTGYNYLD

SEQ ID NO: 13751 - protein, 16 aa, Artificial Sequence
  Description of Artificial Sequence: Synthetic peptide
RSSQSLLHRNGYHYLD

SEQ ID NO: 13752 - protein, 16 aa, Artificial Sequence
  Description of Artificial Sequence: Synthetic peptide
RSSQSLLHRNGYNYLD

SEQ ID NO: 13753 - protein, 16 aa, Artificial Sequence
  Description of Artificial Sequence: Synthetic peptide
RSSQSLLHSTGYNYLD

SEQ ID NO: 13754 - protein, 17 aa, Artificial Sequence
  Description of Artificial Sequence: Synthetic peptide
RSSQSLLDSDDGNTYLD

SEQ ID NO: 13755 - protein, 16 aa, Artificial Sequence
  Description of Artificial Sequence: Synthetic peptide
RSSQSLLYSNGYNYLD

SEQ ID NO: 13756 - protein, 16 aa, Artificial Sequence
  Description of Artificial Sequence: Synthetic peptide
RSSQSLLHRNGYNYLD

SEQ ID NO: 13757 - protein, 16 aa, Artificial Sequence
  Description of Artificial Sequence: Synthetic peptide
RSSQSLLHSNGYNYLD

SEQ ID NO: 13758 - protein, 16 aa, Artificial Sequence
  Description of Artificial Sequence: Synthetic peptide
RSSQSLLHRNGYNYLD

SEQ ID NO: 13759 - protein, 16 aa, Artificial Sequence
  Description of Artificial Sequence: Synthetic peptide
RSSQSLLHRNGYNYLD

SEQ ID NO: 13760 - protein, 16 aa, Artificial Sequence
  Description of Artificial Sequence: Synthetic peptide
RSSQSLLHRNGYNYLD

SEQ ID NO: 13761 - protein, 16 aa, Artificial Sequence
  Description of Artificial Sequence: Synthetic peptide
RSSQSLLHRSGYNYLD

SEQ ID NO: 13762 - protein, 12 aa, Artificial Sequence
  Description of Artificial Sequence: Synthetic peptide
RASQSVSSSYLA

SEQ ID NO: 13763 - protein, 12 aa, Artificial Sequence
  Description of Artificial Sequence: Synthetic peptide
RASQSVSSSYLA

SEQ ID NO: 13764 - protein, 12 aa, Artificial Sequence
  Description of Artificial Sequence: Synthetic peptide
RASQSVSSGYLA

SEQ ID NO: 13765 - protein, 12 aa, Artificial Sequence
  Description of Artificial Sequence: Synthetic peptide
RASQSVSSSYLA

SEQ ID NO: 13766 - protein, 12 aa, Artificial Sequence
  Description of Artificial Sequence: Synthetic peptide
RASQSVSSSYLA

SEQ ID NO: 13767 - protein, 12 aa, Artificial Sequence
  Description of Artificial Sequence: Synthetic peptide
RASQSVSSSYLA

SEQ ID NO: 13768 - protein, 12 aa, Artificial Sequence
  Description of Artificial Sequence: Synthetic peptide
RASQSVSSSYLA

SEQ ID NO: 13769 - protein, 12 aa, Artificial Sequence
  Description of Artificial Sequence: Synthetic peptide
RASQSVSSSYLA

SEQ ID NO: 13770 - protein, 12 aa, Artificial Sequence
  Description of Artificial Sequence: Synthetic peptide
RASQSVSSSYLA

SEQ ID NO: 13771 - protein, 16 aa, Artificial Sequence
  Description of Artificial Sequence: Synthetic peptide
RSSQSLLHSNGYNYLD

SEQ ID NO: 13772 - protein, 16 aa, Artificial Sequence
  Description of Artificial Sequence: Synthetic peptide
RSSQSLLYSNGYNYLD

SEQ ID NO: 13773 - protein, 16 aa, Artificial Sequence
  Description of Artificial Sequence: Synthetic peptide
RSSQSLLYSNGYHYLD

SEQ ID NO: 13774 - protein, 16 aa, Artificial Sequence
  Description of Artificial Sequence: Synthetic peptide
RSSQSLLYSNGYNYLD

SEQ ID NO: 13775 - protein, 16 aa, Artificial Sequence
  Description of Artificial Sequence: Synthetic peptide
RSSQSLLYSNGYNYLD

SEQ ID NO: 13776 - protein, 16 aa, Artificial Sequence
  Description of Artificial Sequence: Synthetic peptide
RSSQSLLHRNGYNYLD

SEQ ID NO: 13777 - protein, 16 aa, Artificial Sequence
  Description of Artificial Sequence: Synthetic peptide
RSSQSLLHSNGYNYLD

SEQ ID NO: 13778 - protein, 16 aa, Artificial Sequence
  Description of Artificial Sequence: Synthetic peptide
RSSQSLLHRNGYNYLD

SEQ ID NO: 13779 - protein, 16 aa, Artificial Sequence
  Description of Artificial Sequence: Synthetic peptide
RSSQSLLHRNGYHYLD

SEQ ID NO: 13780 - protein, 16 aa, Artificial Sequence
  Description of Artificial Sequence: Synthetic peptide
RSSQSLLHRNGYHYLD

SEQ ID NO: 13781 - protein, 16 aa, Artificial Sequence
  Description of Artificial Sequence: Synthetic peptide
RSSQSLLHRNGYNYLD

SEQ ID NO: 13782 - protein, 16 aa, Artificial Sequence
  Description of Artificial Sequence: Synthetic peptide
RSSQSLLHRNGYNYLD

SEQ ID NO: 13783 - protein, 11 aa, Artificial Sequence
  Description of Artificial Sequence: Synthetic peptide
RASQGISSWLA

SEQ ID NO: 13784 - protein, 11 aa, Artificial Sequence
  Description of Artificial Sequence: Synthetic peptide
RASQGISSWLA

SEQ ID NO: 13785 - protein, 11 aa, Artificial Sequence
  Description of Artificial Sequence: Synthetic peptide
RASQSISSYLN

SEQ ID NO: 13786 - protein, 16 aa, Artificial Sequence
  Description of Artificial Sequence: Synthetic peptide
RSSQSLLHSNGYNYLD

SEQ ID NO: 13787 - protein, 16 aa, Artificial Sequence
  Description of Artificial Sequence: Synthetic peptide
RSSQSLLYSNGYNYLD

SEQ ID NO: 13788 - protein, 16 aa, Artificial Sequence
  Description of Artificial Sequence: Synthetic peptide
RSSQSLLYSNGYNYVD

SEQ ID NO: 13789 - protein, 16 aa, Artificial Sequence
  Description of Artificial Sequence: Synthetic peptide
RSSQSLLYSNGYNYLD

SEQ ID NO: 13790 - protein, 16 aa, Artificial Sequence
  Description of Artificial Sequence: Synthetic peptide
RSSRSLLHSNGYNYLD

SEQ ID NO: 13791 - protein, 16 aa, Artificial Sequence
  Description of Artificial Sequence: Synthetic peptide
RSSQSLLHSNGYNYVD

SEQ ID NO: 13792 - protein, 17 aa, Artificial Sequence
  Description of Artificial Sequence: Synthetic peptide
RSSQSLLDSDDGNTYLD

SEQ ID NO: 13793 - protein, 16 aa, Artificial Sequence
  Description of Artificial Sequence: Synthetic peptide
RSSQSLLYSNGYNYVD

SEQ ID NO: 13794 - protein, 16 aa, Artificial Sequence
  Description of Artificial Sequence: Synthetic peptide
RSSQSLLHRNGYNYLD

SEQ ID NO: 13795 - protein, 11 aa, Artificial Sequence
  Description of Artificial Sequence: Synthetic peptide
RASQSISSYLN

SEQ ID NO: 13796 - protein, 11 aa, Artificial Sequence
  Description of Artificial Sequence: Synthetic peptide
RASQSISSYLN

SEQ ID NO: 13797 - protein, 11 aa, Artificial Sequence
  Description of Artificial Sequence: Synthetic peptide
RASQSISSYLN

SEQ ID NO: 13798 - protein, 11 aa, Artificial Sequence
  Description of Artificial Sequence: Synthetic peptide
QASQDISNYLN

SEQ ID NO: 13799 - protein, 11 aa, Artificial Sequence
  Description of Artificial Sequence: Synthetic peptide
RASQSISSYLN

SEQ ID NO: 13800 - protein, 11 aa, Artificial Sequence
  Description of Artificial Sequence: Synthetic peptide
QASQDISNYLN

SEQ ID NO: 13801 - protein, 11 aa, Artificial Sequence
  Description of Artificial Sequence: Synthetic peptide
QASQDISNYLN

SEQ ID NO: 13802 - protein, 11 aa, Artificial Sequence
  Description of Artificial Sequence: Synthetic peptide
QASQDISNYLN

SEQ ID NO: 13803 - protein, 17 aa, Artificial Sequence
  Description of Artificial Sequence: Synthetic peptide
RSSQSLLDSDDGNTYLD

SEQ ID NO: 13804 - protein, 16 aa, Artificial Sequence
  Description of Artificial Sequence: Synthetic peptide
RSSQSLLYSNGYNYLD

SEQ ID NO: 13805 - protein, 16 aa, Artificial Sequence
  Description of Artificial Sequence: Synthetic peptide
RSSQSLLHSNGYNYLD

SEQ ID NO: 13806 - protein, 16 aa, Artificial Sequence
  Description of Artificial Sequence: Synthetic peptide
RSSQSLLHSNGYNYLD

SEQ ID NO: 13807 - protein, 16 aa, Artificial Sequence
  Description of Artificial Sequence: Synthetic peptide
RSSQSLLYSNGYNYLD

SEQ ID NO: 13808 - protein, 16 aa, Artificial Sequence
  Description of Artificial Sequence: Synthetic peptide
RSSQSLLYSNGYNYVD

SEQ ID NO: 13809 - protein, 16 aa, Artificial Sequence
  Description of Artificial Sequence: Synthetic peptide
RSSQSLLFSNGYYYLD

SEQ ID NO: 13810 - protein, 16 aa, Artificial Sequence
  Description of Artificial Sequence: Synthetic peptide
RSSQSLLHSNGYNYLD

SEQ ID NO: 13811 - protein, 16 aa, Artificial Sequence
  Description of Artificial Sequence: Synthetic peptide
RSSQSLLHSNGYNYLD

SEQ ID NO: 13812 - protein, 16 aa, Artificial Sequence
  Description of Artificial Sequence: Synthetic peptide
RSSQSLLHRNGYNYLD

SEQ ID NO: 13813 - protein, 16 aa, Artificial Sequence
  Description of Artificial Sequence: Synthetic peptide
RSSQSLLHSNGYNYLD

SEQ ID NO: 13814 - protein, 16 aa, Artificial Sequence
  Description of Artificial Sequence: Synthetic peptide
RSSQSLLHSTGYNYVD

SEQ ID NO: 13815 - protein, 16 aa, Artificial Sequence
  Description of Artificial Sequence: Synthetic peptide
RSSQSLLHSSGYNYLD

SEQ ID NO: 13816 - protein, 17 aa, Artificial Sequence
  Description of Artificial Sequence: Synthetic peptide
RSSQSLLDSDDGNTYLD

SEQ ID NO: 13817 - protein, 16 aa, Artificial Sequence
  Description of Artificial Sequence: Synthetic peptide
RSSQSLLFSNGYNYLD

SEQ ID NO: 13818 - protein, 16 aa, Artificial Sequence
  Description of Artificial Sequence: Synthetic peptide
RSSQSLLYSNGYNYLD

SEQ ID NO: 13819 - protein, 16 aa, Artificial Sequence
  Description of Artificial Sequence: Synthetic peptide
RSSQSLLYSNGYNYLD

SEQ ID NO: 13820 - protein, 11 aa, Artificial Sequence
  Description of Artificial Sequence: Synthetic peptide
RASQGISNYLA

SEQ ID NO: 13821 - protein, 11 aa, Artificial Sequence
  Description of Artificial Sequence: Synthetic peptide
RASQGISNYLA

SEQ ID NO: 13822 - protein, 11 aa, Artificial Sequence
  Description of Artificial Sequence: Synthetic peptide
RASQGISNYLA

SEQ ID NO: 13823 - protein, 11 aa, Artificial Sequence
  Description of Artificial Sequence: Synthetic peptide
RASQGISNYLA

SEQ ID NO: 13824 - protein, 11 aa, Artificial Sequence
  Description of Artificial Sequence: Synthetic peptide
RASQGISNYLA

SEQ ID NO: 13825 - protein, 11 aa, Artificial Sequence
  Description of Artificial Sequence: Synthetic peptide
RASQGISNYLA

SEQ ID NO: 13826 - protein, 11 aa, Artificial Sequence
  Description of Artificial Sequence: Synthetic peptide
RASQGISNYLA

SEQ ID NO: 13827 - protein, 17 aa, Artificial Sequence
  Description of Artificial Sequence: Synthetic peptide
RSSQSLLDSDDGNTYLD

SEQ ID NO: 13828 - protein, 16 aa, Artificial Sequence
  Description of Artificial Sequence: Synthetic peptide
RSSQSLLYSNGYNYLD

SEQ ID NO: 13829 - protein, 11 aa, Artificial Sequence
  Description of Artificial Sequence: Synthetic peptide
RASQGISNYLA

SEQ ID NO: 13830 - protein, 11 aa, Artificial Sequence
  Description of Artificial Sequence: Synthetic peptide
RASQGISNYLA

SEQ ID NO: 13831 - protein, 16 aa, Artificial Sequence
  Description of Artificial Sequence: Synthetic peptide
KSSQSLLHSDGKTYLY

SEQ ID NO: 13832 - protein, 16 aa, Artificial Sequence
  Description of Artificial Sequence: Synthetic peptide
KSSQSLLYSNGYNYLD

SEQ ID NO: 13833 - protein, 17 aa, Artificial Sequence
  Description of Artificial Sequence: Synthetic peptide
KSSQSVLYSSNNKNYLA

SEQ ID NO: 13834 - protein, 17 aa, Artificial Sequence
  Description of Artificial Sequence: Synthetic peptide
KSSQSVLYSSNNKNYLA

SEQ ID NO: 13835 - protein, 17 aa, Artificial Sequence
  Description of Artificial Sequence: Synthetic peptide
KSSQSVLYSSNNKNYLA

SEQ ID NO: 13836 - protein, 17 aa, Artificial Sequence
  Description of Artificial Sequence: Synthetic peptide
KSSQSVLYSSNNKNYLA

SEQ ID NO: 13837 - protein, 11 aa, Artificial Sequence
  Description of Artificial Sequence: Synthetic peptide
QASQDISNYLN

SEQ ID NO: 13838 - protein, 11 aa, Artificial Sequence
  Description of Artificial Sequence: Synthetic peptide
QASQDISNYLN

SEQ ID NO: 13839 - protein, 17 aa, Artificial Sequence
  Description of Artificial Sequence: Synthetic peptide
KSSQSVLYSSNNKNYLA

SEQ ID NO: 13840 - protein, 17 aa, Artificial Sequence
  Description of Artificial Sequence: Synthetic peptide
KSSQSVLYSSNNKNYLA

SEQ ID NO: 13841 - protein, 17 aa, Artificial Sequence
  Description of Artificial Sequence: Synthetic peptide
KSSQSVLYSSNNKNYLA

SEQ ID NO: 13842 - protein, 17 aa, Artificial Sequence
  Description of Artificial Sequence: Synthetic peptide
KSSQSVLYSSNNKNYLA

SEQ ID NO: 13843 - protein, 17 aa, Artificial Sequence
  Description of Artificial Sequence: Synthetic peptide
KSSQSVLYSSNNKNYLA

SEQ ID NO: 13844 - protein, 11 aa, Artificial Sequence
  Description of Artificial Sequence: Synthetic peptide
RASQSISSYLN

SEQ ID NO: 13845 - protein, 11 aa, Artificial Sequence
  Description of Artificial Sequence: Synthetic peptide
RASQSISSYLN

SEQ ID NO: 13846 - protein, 11 aa, Artificial Sequence
  Description of Artificial Sequence: Synthetic peptide
RASQSISSYLN

SEQ ID NO: 13847 - protein, 11 aa, Artificial Sequence
  Description of Artificial Sequence: Synthetic peptide
RTSQSISSYLN

SEQ ID NO: 13848 - protein, 11 aa, Artificial Sequence
  Description of Artificial Sequence: Synthetic peptide
RASQSISNYFN

SEQ ID NO: 13849 - protein, 11 aa, Artificial Sequence
  Description of Artificial Sequence: Synthetic peptide
RASQSISSYLN

SEQ ID NO: 13850 - protein, 11 aa, Artificial Sequence
  Description of Artificial Sequence: Synthetic peptide
RTSQSISSYLN

SEQ ID NO: 13851 - protein, 11 aa, Artificial Sequence
  Description of Artificial Sequence: Synthetic peptide
RASQSISSYLN

SEQ ID NO: 13852 - protein, 11 aa, Artificial Sequence
  Description of Artificial Sequence: Synthetic peptide
RTSQSISSYLN

SEQ ID NO: 13853 - protein, 11 aa, Artificial Sequence
  Description of Artificial Sequence: Synthetic peptide
RTSQSISSYLN

SEQ ID NO: 13854 - protein, 11 aa, Artificial Sequence
  Description of Artificial Sequence: Synthetic peptide
RASQSISSYLN

SEQ ID NO: 13855 - protein, 11 aa, Artificial Sequence
  Description of Artificial Sequence: Synthetic peptide
RASQSISSYLN

SEQ ID NO: 13856 - protein, 11 aa, Artificial Sequence
  Description of Artificial Sequence: Synthetic peptide
QASQDISNYLN

SEQ ID NO: 13857 - protein, 11 aa, Artificial Sequence
  Description of Artificial Sequence: Synthetic peptide
RTSQSISSYLN

SEQ ID NO: 13858 - protein, 11 aa, Artificial Sequence
  Description of Artificial Sequence: Synthetic peptide
RTSQSISSYLN

SEQ ID NO: 13859 - protein, 11 aa, Artificial Sequence
  Description of Artificial Sequence: Synthetic peptide
RASQSISSYLN

SEQ ID NO: 13860 - protein, 11 aa, Artificial Sequence
  Description of Artificial Sequence: Synthetic peptide
RASQSISSYLN

SEQ ID NO: 13861 - protein, 11 aa, Artificial Sequence
  Description of Artificial Sequence: Synthetic peptide
QARQDISDYLN

SEQ ID NO: 13862 - protein, 11 aa, Artificial Sequence
  Description of Artificial Sequence: Synthetic peptide
RTSQSINSYLN

SEQ ID NO: 13863 - protein, 11 aa, Artificial Sequence
  Description of Artificial Sequence: Synthetic peptide
RTSQSISSYLN

SEQ ID NO: 13864 - protein, 11 aa, Artificial Sequence
  Description of Artificial Sequence: Synthetic peptide
RTSQSINSYLN

SEQ ID NO: 13865 - protein, 11 aa, Artificial Sequence
  Description of Artificial Sequence: Synthetic peptide
RTSQSISSYLN

SEQ ID NO: 13866 - protein, 11 aa, Artificial Sequence
  Description of Artificial Sequence: Synthetic peptide
RASQFISSYLN

SEQ ID NO: 13867 - protein, 11 aa, Artificial Sequence
  Description of Artificial Sequence: Synthetic peptide
RASQSISSYLN

SEQ ID NO: 13868 - protein, 11 aa, Artificial Sequence
  Description of Artificial Sequence: Synthetic peptide
QASQDISNYLN

SEQ ID NO: 13869 - protein, 11 aa, Artificial Sequence
  Description of Artificial Sequence: Synthetic peptide
RTSQSISSYLN

SEQ ID NO: 13870 - protein, 11 aa, Artificial Sequence
  Description of Artificial Sequence: Synthetic peptide
RTSQSISSYLN

SEQ ID NO: 13871 - protein, 11 aa, Artificial Sequence
  Description of Artificial Sequence: Synthetic peptide
RTSQSISSYLN

SEQ ID NO: 13872 - protein, 11 aa, Artificial Sequence
  Description of Artificial Sequence: Synthetic peptide
RTSQSISSYLN

SEQ ID NO: 13873 - protein, 11 aa, Artificial Sequence
  Description of Artificial Sequence: Synthetic peptide
RTSQSISSYLN

SEQ ID NO: 13874 - protein, 11 aa, Artificial Sequence
  Description of Artificial Sequence: Synthetic peptide
RTSQSISSYLN

SEQ ID NO: 13875 - protein, 11 aa, Artificial Sequence
  Description of Artificial Sequence: Synthetic peptide
RTSQSISSYLN

SEQ ID NO: 13876 - protein, 11 aa, Artificial Sequence
  Description of Artificial Sequence: Synthetic peptide
RTSQSISSYLN

SEQ ID NO: 13877 - protein, 11 aa, Artificial Sequence
  Description of Artificial Sequence: Synthetic peptide
QASQDISNYFN

SEQ ID NO: 13878 - protein, 11 aa, Artificial Sequence
  Description of Artificial Sequence: Synthetic peptide
RTSQSISSYLN

SEQ ID NO: 13879 - protein, 11 aa, Artificial Sequence
  Description of Artificial Sequence: Synthetic peptide
RTSQSISSYLN

SEQ ID NO: 13880 - protein, 11 aa, Artificial Sequence
  Description of Artificial Sequence: Synthetic peptide
RTSQSISSYLN

SEQ ID NO: 13881 - protein, 11 aa, Artificial Sequence
  Description of Artificial Sequence: Synthetic peptide
RASQGISSWLA

SEQ ID NO: 13882 - protein, 11 aa, Artificial Sequence
  Description of Artificial Sequence: Synthetic peptide
QASQDISNYLN

SEQ ID NO: 13883 - protein, 12 aa, Artificial Sequence
  Description of Artificial Sequence: Synthetic peptide
RASQSVSSSYLA

SEQ ID NO: 13884 - protein, 16 aa, Artificial Sequence
  Description of Artificial Sequence: Synthetic peptide
RSSQSLLHRNGYNYLD

SEQ ID NO: 13885 - protein, 11 aa, Artificial Sequence
  Description of Artificial Sequence: Synthetic peptide
RASQGISNYLA

SEQ ID NO: 13886 - protein, 11 aa, Artificial Sequence
  Description of Artificial Sequence: Synthetic peptide
RASQGISNYLA

SEQ ID NO: 13887 - protein, 17 aa, Artificial Sequence
  Description of Artificial Sequence: Synthetic peptide
KSSQSVLYSSNNKNYLA

SEQ ID NO: 13888 - protein, 17 aa, Artificial Sequence
  Description of Artificial Sequence: Synthetic peptide
KSSQSVLYSSNNKNYLA

SEQ ID NO: 13889 - protein, 17 aa, Artificial Sequence
  Description of Artificial Sequence: Synthetic peptide
KSSQSVLYSSNNKNYLA

SEQ ID NO: 13890 - protein, 11 aa, Artificial Sequence
  Description of Artificial Sequence: Synthetic peptide
RASQSISSYLN

SEQ ID NO: 13891 - protein, 11 aa, Artificial Sequence
  Description of Artificial Sequence: Synthetic peptide
RASQSISSYLN

SEQ ID NO: 13892 - protein, 14 aa, Artificial Sequence
  Description of Artificial Sequence: Synthetic peptide
TGTSSDVGGYNYVS

SEQ ID NO: 13893 - protein, 14 aa, Artificial Sequence
  Description of Artificial Sequence: Synthetic peptide
TGTSSDVGGYNYVS

SEQ ID NO: 13894 - protein, 13 aa, Artificial Sequence
  Description of Artificial Sequence: Synthetic peptide
SGSSSNIGSNYVY

SEQ ID NO: 13895 - protein, 13 aa, Artificial Sequence
  Description of Artificial Sequence: Synthetic peptide
SGSSSNIGSNYVY

SEQ ID NO: 13896 - protein, 13 aa, Artificial Sequence
  Description of Artificial Sequence: Synthetic peptide
TGNSNNVGNQGAA

SEQ ID NO: 13897 - protein, 13 aa, Artificial Sequence
  Description of Artificial Sequence: Synthetic peptide
TGNSNNVGNQGAA

SEQ ID NO: 13898 - protein, 13 aa, Artificial Sequence
  Description of Artificial Sequence: Synthetic peptide
TGNSNNVGNQGAA

SEQ ID NO: 13899 - protein, 14 aa, Artificial Sequence
  Description of Artificial Sequence: Synthetic peptide
TGTSSDVGGYNYVS

SEQ ID NO: 13900 - protein, 14 aa, Artificial Sequence
  Description of Artificial Sequence: Synthetic peptide
TGTSSDVGGYNYVS

SEQ ID NO: 13901 - protein, 13 aa, Artificial Sequence
  Description of Artificial Sequence: Synthetic peptide
TGNSNNVGNQGAA

SEQ ID NO: 13902 - protein, 13 aa, Artificial Sequence
  Description of Artificial Sequence: Synthetic peptide
TGNSNNVGNQGAA

SEQ ID NO: 13903 - protein, 11 aa, Artificial Sequence
  Description of Artificial Sequence: Synthetic peptide
GGNNIGSKSVH

SEQ ID NO: 13904 - protein, 11 aa, Artificial Sequence
  Description of Artificial Sequence: Synthetic peptide
GGNNIGSKSVH

SEQ ID NO: 13905 - protein, 11 aa, Artificial Sequence
  Description of Artificial Sequence: Synthetic peptide
GGNNIGSKSVQ

SEQ ID NO: 13906 - protein, 11 aa, Artificial Sequence
  Description of Artificial Sequence: Synthetic peptide
GGNNIGSKSVH

SEQ ID NO: 13907 - protein, 11 aa, Artificial Sequence
  Description of Artificial Sequence: Synthetic peptide
GGNNIGSKSVH

SEQ ID NO: 13908 - protein, 11 aa, Artificial Sequence
  Description of Artificial Sequence: Synthetic peptide
GGNNIGSKSVH

SEQ ID NO: 13909 - protein, 11 aa, Artificial Sequence
  Description of Artificial Sequence: Synthetic peptide
GGNNIGSKSVH

SEQ ID NO: 13910 - protein, 11 aa, Artificial Sequence
  Description of Artificial Sequence: Synthetic peptide
GGNNIGSKSVH

SEQ ID NO: 13911 - protein, 11 aa, Artificial Sequence
  Description of Artificial Sequence: Synthetic peptide
GGNNIGSKSVH

SEQ ID NO: 13912 - protein, 11 aa, Artificial Sequence
  Description of Artificial Sequence: Synthetic peptide
GGNNIGSKSVH

SEQ ID NO: 13913 - protein, 11 aa, Artificial Sequence
  Description of Artificial Sequence: Synthetic peptide
GGNNIGSKSVQ

SEQ ID NO: 13914 - protein, 11 aa, Artificial Sequence
  Description of Artificial Sequence: Synthetic peptide
GGNNIGSKSVH

SEQ ID NO: 13915 - protein, 11 aa, Artificial Sequence
  Description of Artificial Sequence: Synthetic peptide
GGNNIGSKSVQ

SEQ ID NO: 13916 - protein, 11 aa, Artificial Sequence
  Description of Artificial Sequence: Synthetic peptide
GGNNIGSKSVH

SEQ ID NO: 13917 - protein, 11 aa, Artificial Sequence
  Description of Artificial Sequence: Synthetic peptide
GGNNIGSKSVH

SEQ ID NO: 13918 - protein, 11 aa, Artificial Sequence
  Description of Artificial Sequence: Synthetic peptide
GGNNIGIKSVH

SEQ ID NO: 13919 - protein, 11 aa, Artificial Sequence
  Description of Artificial Sequence: Synthetic peptide
GGNNIGSKSVH

SEQ ID NO: 13920 - protein, 11 aa, Artificial Sequence
  Description of Artificial Sequence: Synthetic peptide
GGNNIGSKSVH

SEQ ID NO: 13921 - protein, 11 aa, Artificial Sequence
  Description of Artificial Sequence: Synthetic peptide
GGNNIGSKSVH

SEQ ID NO: 13922 - protein, 11 aa, Artificial Sequence
  Description of Artificial Sequence: Synthetic peptide
GGNNIGSKSVQ

SEQ ID NO: 13923 - protein, 11 aa, Artificial Sequence
  Description of Artificial Sequence: Synthetic peptide
GGNNIGSKSVH

SEQ ID NO: 13924 - protein, 11 aa, Artificial Sequence
  Description of Artificial Sequence: Synthetic peptide
GGNNIGSKSVH

SEQ ID NO: 13925 - protein, 11 aa, Artificial Sequence
  Description of Artificial Sequence: Synthetic peptide
GGNNIGSKSVH

SEQ ID NO: 13926 - protein, 11 aa, Artificial Sequence
  Description of Artificial Sequence: Synthetic peptide
GGNNIGSKSVQ

SEQ ID NO: 13927 - protein, 11 aa, Artificial Sequence
  Description of Artificial Sequence: Synthetic peptide
GGNNIGSKSVH

SEQ ID NO: 13928 - protein, 11 aa, Artificial Sequence
  Description of Artificial Sequence: Synthetic peptide
GGNNIGSKSVH

SEQ ID NO: 13929 - protein, 11 aa, Artificial Sequence
  Description of Artificial Sequence: Synthetic peptide
GGNNIGSKSVH

SEQ ID NO: 13930 - protein, 11 aa, Artificial Sequence
  Description of Artificial Sequence: Synthetic peptide
GGNNIGSKSVH

SEQ ID NO: 13931 - protein, 11 aa, Artificial Sequence
  Description of Artificial Sequence: Synthetic peptide
GGNNIGSKSVH

SEQ ID NO: 13932 - protein, 11 aa, Artificial Sequence
  Description of Artificial Sequence: Synthetic peptide
GGNNIGSKSVH

SEQ ID NO: 13933 - protein, 11 aa, Artificial Sequence
  Description of Artificial Sequence: Synthetic peptide
GGNNIGSKSVH

SEQ ID NO: 13934 - protein, 11 aa, Artificial Sequence
  Description of Artificial Sequence: Synthetic peptide
GGNNIGSKSVH

SEQ ID NO: 13935 - protein, 11 aa, Artificial Sequence
  Description of Artificial Sequence: Synthetic peptide
GGNNIGSKGVQ

SEQ ID NO: 13936 - protein, 11 aa, Artificial Sequence
  Description of Artificial Sequence: Synthetic peptide
GGNNIGSKSVQ

SEQ ID NO: 13937 - protein, 11 aa, Artificial Sequence
  Description of Artificial Sequence: Synthetic peptide
GGNNIGSKSVH

SEQ ID NO: 13938 - protein, 11 aa, Artificial Sequence
  Description of Artificial Sequence: Synthetic peptide
GGNNIGSKSVH

SEQ ID NO: 13939 - protein, 11 aa, Artificial Sequence
  Description of Artificial Sequence: Synthetic peptide
GGNNIGSKSVH

SEQ ID NO: 13940 - protein, 11 aa, Artificial Sequence
  Description of Artificial Sequence: Synthetic peptide
GGNNIGSKSVH

SEQ ID NO: 13941 - protein, 11 aa, Artificial Sequence
  Description of Artificial Sequence: Synthetic peptide
GGNNIGSKSVH

SEQ ID NO: 13942 - protein, 11 aa, Artificial Sequence
  Description of Artificial Sequence: Synthetic peptide
GGNNIGSKSVH

SEQ ID NO: 13943 - protein, 11 aa, Artificial Sequence
  Description of Artificial Sequence: Synthetic peptide
GGNNIGSKSVH

SEQ ID NO: 13944 - protein, 11 aa, Artificial Sequence
  Description of Artificial Sequence: Synthetic peptide
GGNNIGSKSVH

SEQ ID NO: 13945 - protein, 11 aa, Artificial Sequence
  Description of Artificial Sequence: Synthetic peptide
GGNNIGSKSVH

SEQ ID NO: 13946 - protein, 11 aa, Artificial Sequence
  Description of Artificial Sequence: Synthetic peptide
GGNNIGSKSVH

SEQ ID NO: 13947 - protein, 11 aa, Artificial Sequence
  Description of Artificial Sequence: Synthetic peptide
GGNNIGSKSVH

SEQ ID NO: 13948 - protein, 11 aa, Artificial Sequence
  Description of Artificial Sequence: Synthetic peptide
GGNNIGSKSVH

SEQ ID NO: 13949 - protein, 11 aa, Artificial Sequence
  Description of Artificial Sequence: Synthetic peptide
GGNNIGSKSVH

SEQ ID NO: 13950 - protein, 11 aa, Artificial Sequence
  Description of Artificial Sequence: Synthetic peptide
GGNNIGSKSVH

SEQ ID NO: 13951 - protein, 11 aa, Artificial Sequence
  Description of Artificial Sequence: Synthetic peptide
GGNNIGSKSVH

SEQ ID NO: 13952 - protein, 11 aa, Artificial Sequence
  Description of Artificial Sequence: Synthetic peptide
GGNNIGSKSVH

SEQ ID NO: 13953 - protein, 11 aa, Artificial Sequence
  Description of Artificial Sequence: Synthetic peptide
GGNNIGSKSVH

SEQ ID NO: 13954 - protein, 11 aa, Artificial Sequence
  Description of Artificial Sequence: Synthetic peptide
GGNNIGSKSVH

SEQ ID NO: 13955 - protein, 11 aa, Artificial Sequence
  Description of Artificial Sequence: Synthetic peptide
GGNNIGSKSVH

SEQ ID NO: 13956 - protein, 11 aa, Artificial Sequence
  Description of Artificial Sequence: Synthetic peptide
GGNNIGSKSVH

SEQ ID NO: 13957 - protein, 11 aa, Artificial Sequence
  Description of Artificial Sequence: Synthetic peptide
GGNNIGSKSVH

SEQ ID NO: 13958 - protein, 11 aa, Artificial Sequence
  Description of Artificial Sequence: Synthetic peptide
GGNNIGSKSVH

SEQ ID NO: 13959 - protein, 11 aa, Artificial Sequence
  Description of Artificial Sequence: Synthetic peptide
GGNNIGSKSVH

SEQ ID NO: 13960 - protein, 11 aa, Artificial Sequence
  Description of Artificial Sequence: Synthetic peptide
GGNNIGSKSVH

SEQ ID NO: 13961 - protein, 11 aa, Artificial Sequence
  Description of Artificial Sequence: Synthetic peptide
GGNNIGSKSVH

SEQ ID NO: 13962 - protein, 11 aa, Artificial Sequence
  Description of Artificial Sequence: Synthetic peptide
GGNNIGSKSVH

SEQ ID NO: 13963 - protein, 11 aa, Artificial Sequence
  Description of Artificial Sequence: Synthetic peptide
GGNNIGSKSVH

SEQ ID NO: 13964 - protein, 11 aa, Artificial Sequence
  Description of Artificial Sequence: Synthetic peptide
GGNNIGSKSVH

SEQ ID NO: 13965 - protein, 5 aa, Artificial Sequence
  Description of Artificial Sequence: Synthetic peptide
DYYMH

SEQ ID NO: 13966 - protein, 5 aa, Artificial Sequence
  Description of Artificial Sequence: Synthetic peptide
KSWMN

SEQ ID NO: 13967 - protein, 5 aa, Artificial Sequence
  Description of Artificial Sequence: Synthetic peptide
SYAIS

SEQ ID NO: 13968 - protein, 5 aa, Artificial Sequence
  Description of Artificial Sequence: Synthetic peptide
KSWMN

SEQ ID NO: 13969 - protein, 5 aa, Artificial Sequence
  Description of Artificial Sequence: Synthetic peptide
SYAIS

SEQ ID NO: 13970 - protein, 5 aa, Artificial Sequence
  Description of Artificial Sequence: Synthetic peptide
SSWMN

SEQ ID NO: 13971 - protein, 5 aa, Artificial Sequence
  Description of Artificial Sequence: Synthetic peptide
SYDIN

SEQ ID NO: 13972 - protein, 5 aa, Artificial Sequence
  Description of Artificial Sequence: Synthetic peptide
SYDIN

SEQ ID NO: 13973 - protein, 5 aa, Artificial Sequence
  Description of Artificial Sequence: Synthetic peptide
SYDIN

SEQ ID NO: 13974 - protein, 5 aa, Artificial Sequence
  Description of Artificial Sequence: Synthetic peptide
SYDIN

SEQ ID NO: 13975 - protein, 5 aa, Artificial Sequence
  Description of Artificial Sequence: Synthetic peptide
SYDIN

SEQ ID NO: 13976 - protein, 5 aa, Artificial Sequence
  Description of Artificial Sequence: Synthetic peptide
GYDIN

SEQ ID NO: 13977 - protein, 5 aa, Artificial Sequence
  Description of Artificial Sequence: Synthetic peptide
SYDIN

SEQ ID NO: 13978 - protein, 5 aa, Artificial Sequence
  Description of Artificial Sequence: Synthetic peptide
GYYWS

SEQ ID NO: 13979 - protein, 5 aa, Artificial Sequence
  Description of Artificial Sequence: Synthetic peptide
GYYWN

SEQ ID NO: 13980 - protein, 5 aa, Artificial Sequence
  Description of Artificial Sequence: Synthetic peptide
GYYWT

SEQ ID NO: 13981 - protein, 5 aa, Artificial Sequence
  Description of Artificial Sequence: Synthetic peptide
GYYWN

SEQ ID NO: 13982 - protein, 5 aa, Artificial Sequence
  Description of Artificial Sequence: Synthetic peptide
GYYWN

SEQ ID NO: 13983 - protein, 5 aa, Artificial Sequence
  Description of Artificial Sequence: Synthetic peptide
GFYWN

SEQ ID NO: 13984 - protein, 5 aa, Artificial Sequence
  Description of Artificial Sequence: Synthetic peptide
GYYWN

SEQ ID NO: 13985 - protein, 5 aa, Artificial Sequence
  Description of Artificial Sequence: Synthetic peptide
GYYWS

SEQ ID NO: 13986 - protein, 5 aa, Artificial Sequence
  Description of Artificial Sequence: Synthetic peptide
GYYWS

SEQ ID NO: 13987 - protein, 5 aa, Artificial Sequence
  Description of Artificial Sequence: Synthetic peptide
GYYWS

SEQ ID NO: 13988 - protein, 5 aa, Artificial Sequence
  Description of Artificial Sequence: Synthetic peptide
GYYWN

SEQ ID NO: 13989 - protein, 5 aa, Artificial Sequence
  Description of Artificial Sequence: Synthetic peptide
SYAMS

SEQ ID NO: 13990 - protein, 5 aa, Artificial Sequence
  Description of Artificial Sequence: Synthetic peptide
SYAMS

SEQ ID NO: 13991 - protein, 5 aa, Artificial Sequence
  Description of Artificial Sequence: Synthetic peptide
SYAMS

SEQ ID NO: 13992 - protein, 5 aa, Artificial Sequence
  Description of Artificial Sequence: Synthetic peptide
SYAMS

SEQ ID NO: 13993 - protein, 5 aa, Artificial Sequence
  Description of Artificial Sequence: Synthetic peptide
SYAMS

SEQ ID NO: 13994 - protein, 5 aa, Artificial Sequence
  Description of Artificial Sequence: Synthetic peptide
SYAMS

SEQ ID NO: 13995 - protein, 5 aa, Artificial Sequence
  Description of Artificial Sequence: Synthetic peptide
SYAMH

SEQ ID NO: 13996 - protein, 5 aa, Artificial Sequence
  Description of Artificial Sequence: Synthetic peptide
SYRMH

SEQ ID NO: 13997 - protein, 5 aa, Artificial Sequence
  Description of Artificial Sequence: Synthetic peptide
SYGMH

SEQ ID NO: 13998 - protein, 5 aa, Artificial Sequence
  Description of Artificial Sequence: Synthetic peptide
GYYWS

SEQ ID NO: 13999 - protein, 5 aa, Artificial Sequence
  Description of Artificial Sequence: Synthetic peptide
GYYWN

SEQ ID NO: 14000 - protein, 5 aa, Artificial Sequence
  Description of Artificial Sequence: Synthetic peptide
GYYWN

SEQ ID NO: 14001 - protein, 5 aa, Artificial Sequence
  Description of Artificial Sequence: Synthetic peptide
GYYWS

SEQ ID NO: 14002 - protein, 5 aa, Artificial Sequence
  Description of Artificial Sequence: Synthetic peptide
GYYWS

SEQ ID NO: 14003 - protein, 5 aa, Artificial Sequence
  Description of Artificial Sequence: Synthetic peptide
GYYWS

SEQ ID NO: 14004 - protein, 5 aa, Artificial Sequence
  Description of Artificial Sequence: Synthetic peptide
GYYWS

SEQ ID NO: 14005 - protein, 5 aa, Artificial Sequence
  Description of Artificial Sequence: Synthetic peptide
GYYWN

SEQ ID NO: 14006 - protein, 5 aa, Artificial Sequence
  Description of Artificial Sequence: Synthetic peptide
GYYWS

SEQ ID NO: 14007 - protein, 5 aa, Artificial Sequence
  Description of Artificial Sequence: Synthetic peptide
GYYWS

SEQ ID NO: 14008 - protein, 5 aa, Artificial Sequence
  Description of Artificial Sequence: Synthetic peptide
SYAMS

SEQ ID NO: 14009 - protein, 5 aa, Artificial Sequence
  Description of Artificial Sequence: Synthetic peptide
SYAMS

SEQ ID NO: 14010 - protein, 5 aa, Artificial Sequence
  Description of Artificial Sequence: Synthetic peptide
SYAMS

SEQ ID NO: 14011 - protein, 5 aa, Artificial Sequence
  Description of Artificial Sequence: Synthetic peptide
SYAMS

SEQ ID NO: 14012 - protein, 5 aa, Artificial Sequence
  Description of Artificial Sequence: Synthetic peptide
SYAMS

SEQ ID NO: 14013 - protein, 5 aa, Artificial Sequence
  Description of Artificial Sequence: Synthetic peptide
SYAMS

SEQ ID NO: 14014 - protein, 5 aa, Artificial Sequence
  Description of Artificial Sequence: Synthetic peptide
SYGMS

SEQ ID NO: 14015 - protein, 5 aa, Artificial Sequence
  Description of Artificial Sequence: Synthetic peptide
NYAMS

SEQ ID NO: 14016 - protein, 5 aa, Artificial Sequence
  Description of Artificial Sequence: Synthetic peptide
IYGMS

SEQ ID NO: 14017 - protein, 5 aa, Artificial Sequence
  Description of Artificial Sequence: Synthetic peptide
SYAMS

SEQ ID NO: 14018 - protein, 5 aa, Artificial Sequence
  Description of Artificial Sequence: Synthetic peptide
SYAMS

SEQ ID NO: 14019 - protein, 5 aa, Artificial Sequence
  Description of Artificial Sequence: Synthetic peptide
SYGMS

SEQ ID NO: 14020 - protein, 5 aa, Artificial Sequence
  Description of Artificial Sequence: Synthetic peptide
SYAMS

SEQ ID NO: 14021 - protein, 7 aa, Artificial Sequence
  Description of Artificial Sequence: Synthetic peptide
SGGYYWS

SEQ ID NO: 14022 - protein, 7 aa, Artificial Sequence
  Description of Artificial Sequence: Synthetic peptide
RDPYYWS

SEQ ID NO: 14023 - protein, 7 aa, Artificial Sequence
  Description of Artificial Sequence: Synthetic peptide
SGDYYWS

SEQ ID NO: 14024 - protein, 7 aa, Artificial Sequence
  Description of Artificial Sequence: Synthetic peptide
SNPYYWS

SEQ ID NO: 14025 - protein, 7 aa, Artificial Sequence
  Description of Artificial Sequence: Synthetic peptide
SGDYYWS

SEQ ID NO: 14026 - protein, 7 aa, Artificial Sequence
  Description of Artificial Sequence: Synthetic peptide
SGDYYWS

SEQ ID NO: 14027 - protein, 7 aa, Artificial Sequence
  Description of Artificial Sequence: Synthetic peptide
SGDYYWS

SEQ ID NO: 14028 - protein, 7 aa, Artificial Sequence
  Description of Artificial Sequence: Synthetic peptide
SGDYYWS

SEQ ID NO: 14029 - protein, 7 aa, Artificial Sequence
  Description of Artificial Sequence: Synthetic peptide
SNPYYWS

SEQ ID NO: 14030 - protein, 7 aa, Artificial Sequence
  Description of Artificial Sequence: Synthetic peptide
SNPYYWS

SEQ ID NO: 14031 - protein, 7 aa, Artificial Sequence
  Description of Artificial Sequence: Synthetic peptide
SGDYYWS

SEQ ID NO: 14032 - protein, 7 aa, Artificial Sequence
  Description of Artificial Sequence: Synthetic peptide
SGDYYWS

SEQ ID NO: 14033 - protein, 7 aa, Artificial Sequence
  Description of Artificial Sequence: Synthetic peptide
SNPYYWS

SEQ ID NO: 14034 - protein, 7 aa, Artificial Sequence
  Description of Artificial Sequence: Synthetic peptide
SGDYYWS

SEQ ID NO: 14035 - protein, 7 aa, Artificial Sequence
  Description of Artificial Sequence: Synthetic peptide
SNPYYWS

SEQ ID NO: 14036 - protein, 7 aa, Artificial Sequence
  Description of Artificial Sequence: Synthetic peptide
SNPYYWS

SEQ ID NO: 14037 - protein, 7 aa, Artificial Sequence
  Description of Artificial Sequence: Synthetic peptide
SNPYYWS

SEQ ID NO: 14038 - protein, 7 aa, Artificial Sequence
  Description of Artificial Sequence: Synthetic peptide
SNPYYWS

SEQ ID NO: 14039 - protein, 7 aa, Artificial Sequence
  Description of Artificial Sequence: Synthetic peptide
SNPYYWS

SEQ ID NO: 14040 - protein, 5 aa, Artificial Sequence
  Description of Artificial Sequence: Synthetic peptide
SYAMS

SEQ ID NO: 14041 - protein, 5 aa, Artificial Sequence
  Description of Artificial Sequence: Synthetic peptide
SFAMS

SEQ ID NO: 14042 - protein, 5 aa, Artificial Sequence
  Description of Artificial Sequence: Synthetic peptide
SYGMH

SEQ ID NO: 14043 - protein, 5 aa, Artificial Sequence
  Description of Artificial Sequence: Synthetic peptide
RYGMD

SEQ ID NO: 14044 - protein, 5 aa, Artificial Sequence
  Description of Artificial Sequence: Synthetic peptide
RYGMD

SEQ ID NO: 14045 - protein, 5 aa, Artificial Sequence
  Description of Artificial Sequence: Synthetic peptide
SYDIN

SEQ ID NO: 14046 - protein, 5 aa, Artificial Sequence
  Description of Artificial Sequence: Synthetic peptide
SYDIN

SEQ ID NO: 14047 - protein, 5 aa, Artificial Sequence
  Description of Artificial Sequence: Synthetic peptide
SYDIN

SEQ ID NO: 14048 - protein, 5 aa, Artificial Sequence
  Description of Artificial Sequence: Synthetic peptide
SYDIN

SEQ ID NO: 14049 - protein, 5 aa, Artificial Sequence
  Description of Artificial Sequence: Synthetic peptide
SYDIN

SEQ ID NO: 14050 - protein, 5 aa, Artificial Sequence
  Description of Artificial Sequence: Synthetic peptide
SYDIN

SEQ ID NO: 14051 - protein, 5 aa, Artificial Sequence
  Description of Artificial Sequence: Synthetic peptide
SYSMN

SEQ ID NO: 14052 - protein, 5 aa, Artificial Sequence
  Description of Artificial Sequence: Synthetic peptide
GYSMN

SEQ ID NO: 14053 - protein, 5 aa, Artificial Sequence
  Description of Artificial Sequence: Synthetic peptide
SYAMH

SEQ ID NO: 14054 - protein, 5 aa, Artificial Sequence
  Description of Artificial Sequence: Synthetic peptide
RYGMQ

SEQ ID NO: 14055 - protein, 5 aa, Artificial Sequence
  Description of Artificial Sequence: Synthetic peptide
RYGMD

SEQ ID NO: 14056 - protein, 5 aa, Artificial Sequence
  Description of Artificial Sequence: Synthetic peptide
SYYWS

SEQ ID NO: 14057 - protein, 7 aa, Artificial Sequence
  Description of Artificial Sequence: Synthetic peptide
SSRYYWG

SEQ ID NO: 14058 - protein, 7 aa, Artificial Sequence
  Description of Artificial Sequence: Synthetic peptide
SSRYYWG

SEQ ID NO: 14059 - protein, 7 aa, Artificial Sequence
  Description of Artificial Sequence: Synthetic peptide
SSRYYWG

SEQ ID NO: 14060 - protein, 7 aa, Artificial Sequence
  Description of Artificial Sequence: Synthetic peptide
SSRYYWG

SEQ ID NO: 14061 - protein, 7 aa, Artificial Sequence
  Description of Artificial Sequence: Synthetic peptide
SNSAAWN

SEQ ID NO: 14062 - protein, 7 aa, Artificial Sequence
  Description of Artificial Sequence: Synthetic peptide
SNSAAWN

SEQ ID NO: 14063 - protein, 6 aa, Artificial Sequence
  Description of Artificial Sequence: Synthetic peptide
SGYYWG

SEQ ID NO: 14064 - protein, 7 aa, Artificial Sequence
  Description of Artificial Sequence: Synthetic peptide
SSRSYWG

SEQ ID NO: 14065 - protein, 7 aa, Artificial Sequence
  Description of Artificial Sequence: Synthetic peptide
TSGMRVS

SEQ ID NO: 14066 - protein, 7 aa, Artificial Sequence
  Description of Artificial Sequence: Synthetic peptide
THKMGVD

SEQ ID NO: 14067 - protein, 7 aa, Artificial Sequence
  Description of Artificial Sequence: Synthetic peptide
TNKMAVG

SEQ ID NO: 14068 - protein, 7 aa, Artificial Sequence
  Description of Artificial Sequence: Synthetic peptide
THKMGVD

SEQ ID NO: 14069 - protein, 5 aa, Artificial Sequence
  Description of Artificial Sequence: Synthetic peptide
SYAMS

SEQ ID NO: 14070 - protein, 5 aa, Artificial Sequence
  Description of Artificial Sequence: Synthetic peptide
IYALS

SEQ ID NO: 14071 - protein, 5 aa, Artificial Sequence
  Description of Artificial Sequence: Synthetic peptide
SYYWS

SEQ ID NO: 14072 - protein, 7 aa, Artificial Sequence
  Description of Artificial Sequence: Synthetic peptide
SSRSYWG

SEQ ID NO: 14073 - protein, 7 aa, Artificial Sequence
  Description of Artificial Sequence: Synthetic peptide
TSGVGVG

SEQ ID NO: 14074 - protein, 7 aa, Artificial Sequence
  Description of Artificial Sequence: Synthetic peptide
THKMGVD

SEQ ID NO: 14075 - protein, 7 aa, Artificial Sequence
  Description of Artificial Sequence: Synthetic peptide
THKMGVD

SEQ ID NO: 14076 - protein, 7 aa, Artificial Sequence
  Description of Artificial Sequence: Synthetic peptide
THKMGVD

SEQ ID NO: 14077 - protein, 7 aa, Artificial Sequence
  Description of Artificial Sequence: Synthetic peptide
THKMGVD

SEQ ID NO: 14078 - protein, 7 aa, Artificial Sequence
  Description of Artificial Sequence: Synthetic peptide
THKMGVD

SEQ ID NO: 14079 - protein, 7 aa, Artificial Sequence
  Description of Artificial Sequence: Synthetic peptide
THKMGVD

SEQ ID NO: 14080 - protein, 7 aa, Artificial Sequence
  Description of Artificial Sequence: Synthetic peptide
THKMGVD

SEQ ID NO: 14081 - protein, 7 aa, Artificial Sequence
  Description of Artificial Sequence: Synthetic peptide
THKMGVD

SEQ ID NO: 14082 - protein, 7 aa, Artificial Sequence
  Description of Artificial Sequence: Synthetic peptide
THKMGVD

SEQ ID NO: 14083 - protein, 7 aa, Artificial Sequence
  Description of Artificial Sequence: Synthetic peptide
THKMGVD

SEQ ID NO: 14084 - protein, 5 aa, Artificial Sequence
  Description of Artificial Sequence: Synthetic peptide
SYAMS

SEQ ID NO: 14085 - protein, 5 aa, Artificial Sequence
  Description of Artificial Sequence: Synthetic peptide
SYAMS

SEQ ID NO: 14086 - protein, 5 aa, Artificial Sequence
  Description of Artificial Sequence: Synthetic peptide
SYAVS

SEQ ID NO: 14087 - protein, 7 aa, Artificial Sequence
  Description of Artificial Sequence: Synthetic peptide
SGGYYWS

SEQ ID NO: 14088 - protein, 7 aa, Artificial Sequence
  Description of Artificial Sequence: Synthetic peptide
SGDYYWS

SEQ ID NO: 14089 - protein, 7 aa, Artificial Sequence
  Description of Artificial Sequence: Synthetic peptide
SNPYYWS

SEQ ID NO: 14090 - protein, 7 aa, Artificial Sequence
  Description of Artificial Sequence: Synthetic peptide
SNPYYWS

SEQ ID NO: 14091 - protein, 7 aa, Artificial Sequence
  Description of Artificial Sequence: Synthetic peptide
SNPYYWS

SEQ ID NO: 14092 - protein, 7 aa, Artificial Sequence
  Description of Artificial Sequence: Synthetic peptide
SGGYYWS

SEQ ID NO: 14093 - protein, 7 aa, Artificial Sequence
  Description of Artificial Sequence: Synthetic peptide
SNPYYWS

SEQ ID NO: 14094 - protein, 5 aa, Artificial Sequence
  Description of Artificial Sequence: Synthetic peptide
NAWMS

SEQ ID NO: 14095 - protein, 5 aa, Artificial Sequence
  Description of Artificial Sequence: Synthetic peptide
NAWMS

SEQ ID NO: 14096 - protein, 5 aa, Artificial Sequence
  Description of Artificial Sequence: Synthetic peptide
NAWMS

SEQ ID NO: 14097 - protein, 5 aa, Artificial Sequence
  Description of Artificial Sequence: Synthetic peptide
NAWMS

SEQ ID NO: 14098 - protein, 5 aa, Artificial Sequence
  Description of Artificial Sequence: Synthetic peptide
NAWMS

SEQ ID NO: 14099 - protein, 5 aa, Artificial Sequence
  Description of Artificial Sequence: Synthetic peptide
NAWMS

SEQ ID NO: 14100 - protein, 5 aa, Artificial Sequence
  Description of Artificial Sequence: Synthetic peptide
NAWMS

SEQ ID NO: 14101 - protein, 5 aa, Artificial Sequence
  Description of Artificial Sequence: Synthetic peptide
NAWMS

SEQ ID NO: 14102 - protein, 5 aa, Artificial Sequence
  Description of Artificial Sequence: Synthetic peptide
NAWMS

SEQ ID NO: 14103 - protein, 5 aa, Artificial Sequence
  Description of Artificial Sequence: Synthetic peptide
NAWMS

SEQ ID NO: 14104 - protein, 5 aa, Artificial Sequence
  Description of Artificial Sequence: Synthetic peptide
NAWMS

SEQ ID NO: 14105 - protein, 5 aa, Artificial Sequence
  Description of Artificial Sequence: Synthetic peptide
NAWMS

SEQ ID NO: 14106 - protein, 5 aa, Artificial Sequence
  Description of Artificial Sequence: Synthetic peptide
NAWMS

SEQ ID NO: 14107 - protein, 5 aa, Artificial Sequence
  Description of Artificial Sequence: Synthetic peptide
NAWMS

SEQ ID NO: 14108 - protein, 5 aa, Artificial Sequence
  Description of Artificial Sequence: Synthetic peptide
NAWMS

SEQ ID NO: 14109 - protein, 5 aa, Artificial Sequence
  Description of Artificial Sequence: Synthetic peptide
NAWMS

SEQ ID NO: 14110 - protein, 5 aa, Artificial Sequence
  Description of Artificial Sequence: Synthetic peptide
NAWMS

SEQ ID NO: 14111 - protein, 5 aa, Artificial Sequence
  Description of Artificial Sequence: Synthetic peptide
NAWMS

SEQ ID NO: 14112 - protein, 5 aa, Artificial Sequence
  Description of Artificial Sequence: Synthetic peptide
NAWMS

SEQ ID NO: 14113 - protein, 5 aa, Artificial Sequence
  Description of Artificial Sequence: Synthetic peptide
NAWMS

SEQ ID NO: 14114 - protein, 5 aa, Artificial Sequence
  Description of Artificial Sequence: Synthetic peptide
NAWMS

SEQ ID NO: 14115 - protein, 5 aa, Artificial Sequence
  Description of Artificial Sequence: Synthetic peptide
NAWMS

SEQ ID NO: 14116 - protein, 5 aa, Artificial Sequence
  Description of Artificial Sequence: Synthetic peptide
NAWMS

SEQ ID NO: 14117 - protein, 5 aa, Artificial Sequence
  Description of Artificial Sequence: Synthetic peptide
NAWMS

SEQ ID NO: 14118 - protein, 5 aa, Artificial Sequence
  Description of Artificial Sequence: Synthetic peptide
SYYWS

SEQ ID NO: 14119 - protein, 5 aa, Artificial Sequence
  Description of Artificial Sequence: Synthetic peptide
SYYWS

SEQ ID NO: 14120 - protein, 5 aa, Artificial Sequence
  Description of Artificial Sequence: Synthetic peptide
DFFWS

SEQ ID NO: 14121 - protein, 5 aa, Artificial Sequence
  Description of Artificial Sequence: Synthetic peptide
NYYWS

SEQ ID NO: 14122 - protein, 5 aa, Artificial Sequence
  Description of Artificial Sequence: Synthetic peptide
SYAMS

SEQ ID NO: 14123 - protein, 5 aa, Artificial Sequence
  Description of Artificial Sequence: Synthetic peptide
SYAMS

SEQ ID NO: 14124 - protein, 5 aa, Artificial Sequence
  Description of Artificial Sequence: Synthetic peptide
SHAMS

SEQ ID NO: 14125 - protein, 5 aa, Artificial Sequence
  Description of Artificial Sequence: Synthetic peptide
SYAMS

SEQ ID NO: 14126 - protein, 5 aa, Artificial Sequence
  Description of Artificial Sequence: Synthetic peptide
SYAMS

SEQ ID NO: 14127 - protein, 5 aa, Artificial Sequence
  Description of Artificial Sequence: Synthetic peptide
SHAMS

SEQ ID NO: 14128 - protein, 5 aa, Artificial Sequence
  Description of Artificial Sequence: Synthetic peptide
SYAMS

SEQ ID NO: 14129 - protein, 5 aa, Artificial Sequence
  Description of Artificial Sequence: Synthetic peptide
SHAMS

SEQ ID NO: 14130 - protein, 5 aa, Artificial Sequence
  Description of Artificial Sequence: Synthetic peptide
SYAMS

SEQ ID NO: 14131 - protein, 5 aa, Artificial Sequence
  Description of Artificial Sequence: Synthetic peptide
SYAMS

SEQ ID NO: 14132 - protein, 5 aa, Artificial Sequence
  Description of Artificial Sequence: Synthetic peptide
SYAMN

SEQ ID NO: 14133 - protein, 5 aa, Artificial Sequence
  Description of Artificial Sequence: Synthetic peptide
SYAMS

SEQ ID NO: 14134 - protein, 5 aa, Artificial Sequence
  Description of Artificial Sequence: Synthetic peptide
SHAMS

SEQ ID NO: 14135 - protein, 5 aa, Artificial Sequence
  Description of Artificial Sequence: Synthetic peptide
SYAMS

SEQ ID NO: 14136 - protein, 5 aa, Artificial Sequence
  Description of Artificial Sequence: Synthetic peptide
SYAMS

SEQ ID NO: 14137 - protein, 5 aa, Artificial Sequence
  Description of Artificial Sequence: Synthetic peptide
SYAMS

SEQ ID NO: 14138 - protein, 5 aa, Artificial Sequence
  Description of Artificial Sequence: Synthetic peptide
SYAMS

SEQ ID NO: 14139 - protein, 5 aa, Artificial Sequence
  Description of Artificial Sequence: Synthetic peptide
SYAMS

SEQ ID NO: 14140 - protein, 5 aa, Artificial Sequence
  Description of Artificial Sequence: Synthetic peptide
SYAMS

SEQ ID NO: 14141 - protein, 5 aa, Artificial Sequence
  Description of Artificial Sequence: Synthetic peptide
SYAMS

SEQ ID NO: 14142 - protein, 5 aa, Artificial Sequence
  Description of Artificial Sequence: Synthetic peptide
SYAMN

SEQ ID NO: 14143 - protein, 5 aa, Artificial Sequence
  Description of Artificial Sequence: Synthetic peptide
SYAMS

SEQ ID NO: 14144 - protein, 5 aa, Artificial Sequence
  Description of Artificial Sequence: Synthetic peptide
SYAMS

SEQ ID NO: 14145 - protein, 5 aa, Artificial Sequence
  Description of Artificial Sequence: Synthetic peptide
SYAMS

SEQ ID NO: 14146 - protein, 5 aa, Artificial Sequence
  Description of Artificial Sequence: Synthetic peptide
SYAMS

SEQ ID NO: 14147 - protein, 5 aa, Artificial Sequence
  Description of Artificial Sequence: Synthetic peptide
SYAMS

SEQ ID NO: 14148 - protein, 5 aa, Artificial Sequence
  Description of Artificial Sequence: Synthetic peptide
SYAMS

SEQ ID NO: 14149 - protein, 5 aa, Artificial Sequence
  Description of Artificial Sequence: Synthetic peptide
SYAMS

SEQ ID NO: 14150 - protein, 5 aa, Artificial Sequence
  Description of Artificial Sequence: Synthetic peptide
SYAMH

SEQ ID NO: 14151 - protein, 5 aa, Artificial Sequence
  Description of Artificial Sequence: Synthetic peptide
SYAMT

SEQ ID NO: 14152 - protein, 5 aa, Artificial Sequence
  Description of Artificial Sequence: Synthetic peptide
SYAMS

SEQ ID NO: 14153 - protein, 5 aa, Artificial Sequence
  Description of Artificial Sequence: Synthetic peptide
SYAMS

SEQ ID NO: 14154 - protein, 5 aa, Artificial Sequence
  Description of Artificial Sequence: Synthetic peptide
SYAMS

SEQ ID NO: 14155 - protein, 5 aa, Artificial Sequence
  Description of Artificial Sequence: Synthetic peptide
SHAMS

SEQ ID NO: 14156 - protein, 5 aa, Artificial Sequence
  Description of Artificial Sequence: Synthetic peptide
SHAMS

SEQ ID NO: 14157 - protein, 5 aa, Artificial Sequence
  Description of Artificial Sequence: Synthetic peptide
SHAMS

SEQ ID NO: 14158 - protein, 5 aa, Artificial Sequence
  Description of Artificial Sequence: Synthetic peptide
SYAMS

SEQ ID NO: 14159 - protein, 5 aa, Artificial Sequence
  Description of Artificial Sequence: Synthetic peptide
SYAMS

SEQ ID NO: 14160 - protein, 5 aa, Artificial Sequence
  Description of Artificial Sequence: Synthetic peptide
SHAMS

SEQ ID NO: 14161 - protein, 5 aa, Artificial Sequence
  Description of Artificial Sequence: Synthetic peptide
SYAMS

SEQ ID NO: 14162 - protein, 5 aa, Artificial Sequence
  Description of Artificial Sequence: Synthetic peptide
SYAMN

SEQ ID NO: 14163 - protein, 5 aa, Artificial Sequence
  Description of Artificial Sequence: Synthetic peptide
SHAMS

SEQ ID NO: 14164 - protein, 5 aa, Artificial Sequence
  Description of Artificial Sequence: Synthetic peptide
SYAMS

SEQ ID NO: 14165 - protein, 5 aa, Artificial Sequence
  Description of Artificial Sequence: Synthetic peptide
SYAMS

SEQ ID NO: 14166 - protein, 5 aa, Artificial Sequence
  Description of Artificial Sequence: Synthetic peptide
SYAMT

SEQ ID NO: 14167 - protein, 5 aa, Artificial Sequence
  Description of Artificial Sequence: Synthetic peptide
SHAMS

SEQ ID NO: 14168 - protein, 5 aa, Artificial Sequence
  Description of Artificial Sequence: Synthetic peptide
SYAMS

SEQ ID NO: 14169 - protein, 5 aa, Artificial Sequence
  Description of Artificial Sequence: Synthetic peptide
SYAMS

SEQ ID NO: 14170 - protein, 5 aa, Artificial Sequence
  Description of Artificial Sequence: Synthetic peptide
SHAMS

SEQ ID NO: 14171 - protein, 5 aa, Artificial Sequence
  Description of Artificial Sequence: Synthetic peptide
SHAMS

SEQ ID NO: 14172 - protein, 5 aa, Artificial Sequence
  Description of Artificial Sequence: Synthetic peptide
SHAMS

SEQ ID NO: 14173 - protein, 5 aa, Artificial Sequence
  Description of Artificial Sequence: Synthetic peptide
SHAMS

SEQ ID NO: 14174 - protein, 5 aa, Artificial Sequence
  Description of Artificial Sequence: Synthetic peptide
SYAMS

SEQ ID NO: 14175 - protein, 5 aa, Artificial Sequence
  Description of Artificial Sequence: Synthetic peptide
SYAMS

SEQ ID NO: 14176 - protein, 5 aa, Artificial Sequence
  Description of Artificial Sequence: Synthetic peptide
SYAMS

SEQ ID NO: 14177 - protein, 5 aa, Artificial Sequence
  Description of Artificial Sequence: Synthetic peptide
SYAMS

SEQ ID NO: 14178 - protein, 5 aa, Artificial Sequence
  Description of Artificial Sequence: Synthetic peptide
SHAMS

SEQ ID NO: 14179 - protein, 5 aa, Artificial Sequence
  Description of Artificial Sequence: Synthetic peptide
SHAMS

SEQ ID NO: 14180 - protein, 5 aa, Artificial Sequence
  Description of Artificial Sequence: Synthetic peptide
SYAMS

SEQ ID NO: 14181 - protein, 5 aa, Artificial Sequence
  Description of Artificial Sequence: Synthetic peptide
SYAMS

SEQ ID NO: 14182 - protein, 5 aa, Artificial Sequence
  Description of Artificial Sequence: Synthetic peptide
SYAMH

SEQ ID NO: 14183 - protein, 5 aa, Artificial Sequence
  Description of Artificial Sequence: Synthetic peptide
TYGMH

SEQ ID NO: 14184 - protein, 5 aa, Artificial Sequence
  Description of Artificial Sequence: Synthetic peptide
TYGMH

SEQ ID NO: 14185 - protein, 5 aa, Artificial Sequence
  Description of Artificial Sequence: Synthetic peptide
TYGMH

SEQ ID NO: 14186 - protein, 5 aa, Artificial Sequence
  Description of Artificial Sequence: Synthetic peptide
SYGIS

SEQ ID NO: 14187 - protein, 5 aa, Artificial Sequence
  Description of Artificial Sequence: Synthetic peptide
RNGLS

SEQ ID NO: 14188 - protein, 5 aa, Artificial Sequence
  Description of Artificial Sequence: Synthetic peptide
RNGLS

SEQ ID NO: 14189 - protein, 5 aa, Artificial Sequence
  Description of Artificial Sequence: Synthetic peptide
DYYMS

SEQ ID NO: 14190 - protein, 5 aa, Artificial Sequence
  Description of Artificial Sequence: Synthetic peptide
DYYMS

SEQ ID NO: 14191 - protein, 5 aa, Artificial Sequence
  Description of Artificial Sequence: Synthetic peptide
DYYMS

SEQ ID NO: 14192 - protein, 15 aa, Artificial Sequence
  Description of Artificial Sequence: Synthetic peptide
WYQQKPGQPPKLLIY

SEQ ID NO: 14193 - protein, 15 aa, Artificial Sequence
  Description of Artificial Sequence: Synthetic peptide
WYQQKPGQSPKLLIY

SEQ ID NO: 14194 - protein, 15 aa, Artificial Sequence
  Description of Artificial Sequence: Synthetic peptide
WYQQKPGQPPKLLIY

SEQ ID NO: 14195 - protein, 15 aa, Artificial Sequence
  Description of Artificial Sequence: Synthetic peptide
WYQQKPGQPPKLLIY

SEQ ID NO: 14196 - protein, 15 aa, Artificial Sequence
  Description of Artificial Sequence: Synthetic peptide
WYQQKPDQSPKLLIK

SEQ ID NO: 14197 - protein, 15 aa, Artificial Sequence
  Description of Artificial Sequence: Synthetic peptide
WYQQKLGSSPKLWIY

SEQ ID NO: 14198 - protein, 15 aa, Artificial Sequence
  Description of Artificial Sequence: Synthetic peptide
WYQQKPGKAPKLLIY

SEQ ID NO: 14199 - protein, 15 aa, Artificial Sequence
  Description of Artificial Sequence: Synthetic peptide
WYQQKQGKSPQLLVY

SEQ ID NO: 14200 - protein, 15 aa, Artificial Sequence
  Description of Artificial Sequence: Synthetic peptide
WYLQKPGQSPQLLIY

SEQ ID NO: 14201 - protein, 15 aa, Artificial Sequence
  Description of Artificial Sequence: Synthetic peptide
WYLQKPGQSPQLLIY

SEQ ID NO: 14202 - protein, 15 aa, Artificial Sequence
  Description of Artificial Sequence: Synthetic peptide
WYLQKPGQSPQLLIY

SEQ ID NO: 14203 - protein, 15 aa, Artificial Sequence
  Description of Artificial Sequence: Synthetic peptide
WYLQKPGQSPQLLIY

SEQ ID NO: 14204 - protein, 15 aa, Artificial Sequence
  Description of Artificial Sequence: Synthetic peptide
WYLQKPGQSPQLLIY

SEQ ID NO: 14205 - protein, 15 aa, Artificial Sequence
  Description of Artificial Sequence: Synthetic peptide
WYLQKPGQSPQLLIY

SEQ ID NO: 14206 - protein, 15 aa, Artificial Sequence
  Description of Artificial Sequence: Synthetic peptide
WYLQKPGQSPQLLIY

SEQ ID NO: 14207 - protein, 15 aa, Artificial Sequence
  Description of Artificial Sequence: Synthetic peptide
WYLQKPGQSPQLLIY

SEQ ID NO: 14208 - protein, 15 aa, Artificial Sequence
  Description of Artificial Sequence: Synthetic peptide
WYLQKPGQSPQLLIY

SEQ ID NO: 14209 - protein, 15 aa, Artificial Sequence
  Description of Artificial Sequence: Synthetic peptide
WYLQKPGQSPQLLIY

SEQ ID NO: 14210 - protein, 15 aa, Artificial Sequence
  Description of Artificial Sequence: Synthetic peptide
WYLQKPGQSPQLLIY

SEQ ID NO: 14211 - protein, 15 aa, Artificial Sequence
  Description of Artificial Sequence: Synthetic peptide
WYLQKPGQSPQLLIY

SEQ ID NO: 14212 - protein, 15 aa, Artificial Sequence
  Description of Artificial Sequence: Synthetic peptide
WYLQKPGQSPQLLIY

SEQ ID NO: 14213 - protein, 15 aa, Artificial Sequence
  Description of Artificial Sequence: Synthetic peptide
WYLQKPGQSPQLLIY

SEQ ID NO: 14214 - protein, 15 aa, Artificial Sequence
  Description of Artificial Sequence: Synthetic peptide
WYLHKPGQSPQLLIY

SEQ ID NO: 14215 - protein, 15 aa, Artificial Sequence
  Description of Artificial Sequence: Synthetic peptide
WYLQKPGQSPQLLIY

SEQ ID NO: 14216 - protein, 15 aa, Artificial Sequence
  Description of Artificial Sequence: Synthetic peptide
WYLQKPGQSPQLLIY

SEQ ID NO: 14217 - protein, 15 aa, Artificial Sequence
  Description of Artificial Sequence: Synthetic peptide
WYLQKPGQSPQLLIY

SEQ ID NO: 14218 - protein, 15 aa, Artificial Sequence
  Description of Artificial Sequence: Synthetic peptide
WYLQKPGQSPQLLIY

SEQ ID NO: 14219 - protein, 15 aa, Artificial Sequence
  Description of Artificial Sequence: Synthetic peptide
WYLQKPGQSPQLLIY

SEQ ID NO: 14220 - protein, 15 aa, Artificial Sequence
  Description of Artificial Sequence: Synthetic peptide
WYQQKPGQAPRLLIY

SEQ ID NO: 14221 - protein, 15 aa, Artificial Sequence
  Description of Artificial Sequence: Synthetic peptide
WYQQKPGQAPRLLIY

SEQ ID NO: 14222 - protein, 15 aa, Artificial Sequence
  Description of Artificial Sequence: Synthetic peptide
WYQQKPGQAPRLLIY

SEQ ID NO: 14223 - protein, 15 aa, Artificial Sequence
  Description of Artificial Sequence: Synthetic peptide
WYQQKPGQAPRLLIY

SEQ ID NO: 14224 - protein, 15 aa, Artificial Sequence
  Description of Artificial Sequence: Synthetic peptide
WYQQKPGQAPRLLIY

SEQ ID NO: 14225 - protein, 15 aa, Artificial Sequence
  Description of Artificial Sequence: Synthetic peptide
WYQQKPGQAPRLLIY

SEQ ID NO: 14226 - protein, 15 aa, Artificial Sequence
  Description of Artificial Sequence: Synthetic peptide
WYQQKPGQAPRLLIY

SEQ ID NO: 14227 - protein, 15 aa, Artificial Sequence
  Description of Artificial Sequence: Synthetic peptide
WYQQKPGQAPRLLIY

SEQ ID NO: 14228 - protein, 15 aa, Artificial Sequence
  Description of Artificial Sequence: Synthetic peptide
WYQQKPGQAPRLLIY

SEQ ID NO: 14229 - protein, 15 aa, Artificial Sequence
  Description of Artificial Sequence: Synthetic peptide
WYLQKPGQSPQLLIY

SEQ ID NO: 14230 - protein, 15 aa, Artificial Sequence
  Description of Artificial Sequence: Synthetic peptide
WYLQKPGQSPQLLIY

SEQ ID NO: 14231 - protein, 15 aa, Artificial Sequence
  Description of Artificial Sequence: Synthetic peptide
WYLQKPGQSPQLLIF

SEQ ID NO: 14232 - protein, 15 aa, Artificial Sequence
  Description of Artificial Sequence: Synthetic peptide
WYLQKPGQSPQLLIY

SEQ ID NO: 14233 - protein, 15 aa, Artificial Sequence
  Description of Artificial Sequence: Synthetic peptide
WYLQKPGQSPQLLIY

SEQ ID NO: 14234 - protein, 15 aa, Artificial Sequence
  Description of Artificial Sequence: Synthetic peptide
WYLQKPGQSPQLLIY

SEQ ID NO: 14235 - protein, 15 aa, Artificial Sequence
  Description of Artificial Sequence: Synthetic peptide
WYLQKPGQSPQLLIY

SEQ ID NO: 14236 - protein, 15 aa, Artificial Sequence
  Description of Artificial Sequence: Synthetic peptide
WYLQKPGQSPQLLIY

SEQ ID NO: 14237 - protein, 15 aa, Artificial Sequence
  Description of Artificial Sequence: Synthetic peptide
WYLQKPGQSPQLLIY

SEQ ID NO: 14238 - protein, 15 aa, Artificial Sequence
  Description of Artificial Sequence: Synthetic peptide
WYLQKPGQSPQLLIY

SEQ ID NO: 14239 - protein, 15 aa, Artificial Sequence
  Description of Artificial Sequence: Synthetic peptide
WYLQKPGQSPQLLIY

SEQ ID NO: 14240 - protein, 15 aa, Artificial Sequence
  Description of Artificial Sequence: Synthetic peptide
WYLQKPGQSPQLLIY

SEQ ID NO: 14241 - protein, 15 aa, Artificial Sequence
  Description of Artificial Sequence: Synthetic peptide
WYQQKPGKAPKLLIY

SEQ ID NO: 14242 - protein, 15 aa, Artificial Sequence
  Description of Artificial Sequence: Synthetic peptide
WYQQKPGKAPKLLIY

SEQ ID NO: 14243 - protein, 15 aa, Artificial Sequence
  Description of Artificial Sequence: Synthetic peptide
WYQQKPGKAPKLLIY

SEQ ID NO: 14244 - protein, 15 aa, Artificial Sequence
  Description of Artificial Sequence: Synthetic peptide
WYLQKPGQSPQLLIY

SEQ ID NO: 14245 - protein, 15 aa, Artificial Sequence
  Description of Artificial Sequence: Synthetic peptide
WYLQKPGQSPQLLIY

SEQ ID NO: 14246 - protein, 15 aa, Artificial Sequence
  Description of Artificial Sequence: Synthetic peptide
WYLQKPGQSPQLLIY

SEQ ID NO: 14247 - protein, 15 aa, Artificial Sequence
  Description of Artificial Sequence: Synthetic peptide
WYLQKPGQSPHLLIY

SEQ ID NO: 14248 - protein, 15 aa, Artificial Sequence
  Description of Artificial Sequence: Synthetic peptide
WYLQKPGQSPQLLIY

SEQ ID NO: 14249 - protein, 15 aa, Artificial Sequence
  Description of Artificial Sequence: Synthetic peptide
WYLQKPGQSPQLLIY

SEQ ID NO: 14250 - protein, 15 aa, Artificial Sequence
  Description of Artificial Sequence: Synthetic peptide
WYLQKPGQSPQLLIY

SEQ ID NO: 14251 - protein, 15 aa, Artificial Sequence
  Description of Artificial Sequence: Synthetic peptide
WYLQKPGQSPQLLIY

SEQ ID NO: 14252 - protein, 15 aa, Artificial Sequence
  Description of Artificial Sequence: Synthetic peptide
WYLQKPGQSPQLLIY

SEQ ID NO: 14253 - protein, 15 aa, Artificial Sequence
  Description of Artificial Sequence: Synthetic peptide
WYQQKPGKAPKLLIY

SEQ ID NO: 14254 - protein, 15 aa, Artificial Sequence
  Description of Artificial Sequence: Synthetic peptide
WYQQKPGKAPKLLIY

SEQ ID NO: 14255 - protein, 15 aa, Artificial Sequence
  Description of Artificial Sequence: Synthetic peptide
WYQQKPGKAPKLLIY

SEQ ID NO: 14256 - protein, 15 aa, Artificial Sequence
  Description of Artificial Sequence: Synthetic peptide
WYQQKPGKAPKLLIY

SEQ ID NO: 14257 - protein, 15 aa, Artificial Sequence
  Description of Artificial Sequence: Synthetic peptide
WYQQKPGKAPKLLIY

SEQ ID NO: 14258 - protein, 15 aa, Artificial Sequence
  Description of Artificial Sequence: Synthetic peptide
WYQQKPGKAPKLLIY

SEQ ID NO: 14259 - protein, 15 aa, Artificial Sequence
  Description of Artificial Sequence: Synthetic peptide
WYQQKPGKAPKLLIY

SEQ ID NO: 14260 - protein, 15 aa, Artificial Sequence
  Description of Artificial Sequence: Synthetic peptide
WYQQKPGKAPKLLIY

SEQ ID NO: 14261 - protein, 15 aa, Artificial Sequence
  Description of Artificial Sequence: Synthetic peptide
WYLQKPGQSPQLLIY

SEQ ID NO: 14262 - protein, 15 aa, Artificial Sequence
  Description of Artificial Sequence: Synthetic peptide
WYLQKPGQSPQLLIY

SEQ ID NO: 14263 - protein, 15 aa, Artificial Sequence
  Description of Artificial Sequence: Synthetic peptide
WYLQKPGQSPQLLIY

SEQ ID NO: 14264 - protein, 15 aa, Artificial Sequence
  Description of Artificial Sequence: Synthetic peptide
WYLQKPGQSPQLLIY

SEQ ID NO: 14265 - protein, 15 aa, Artificial Sequence
  Description of Artificial Sequence: Synthetic peptide
WYLQKPGQSPQLLIY

SEQ ID NO: 14266 - protein, 15 aa, Artificial Sequence
  Description of Artificial Sequence: Synthetic peptide
WYLQKPGQSPQLLIY

SEQ ID NO: 14267 - protein, 15 aa, Artificial Sequence
  Description of Artificial Sequence: Synthetic peptide
WYLQKPGQSPQLLIY

SEQ ID NO: 14268 - protein, 15 aa, Artificial Sequence
  Description of Artificial Sequence: Synthetic peptide
WYLQKPGQSPQLLIY

SEQ ID NO: 14269 - protein, 15 aa, Artificial Sequence
  Description of Artificial Sequence: Synthetic peptide
WYLQKPGQSPQLLIY

SEQ ID NO: 14270 - protein, 15 aa, Artificial Sequence
  Description of Artificial Sequence: Synthetic peptide
WYLHKPGQSPQLLIY

SEQ ID NO: 14271 - protein, 15 aa, Artificial Sequence
  Description of Artificial Sequence: Synthetic peptide
WYLQKPGQSPQLLIY

SEQ ID NO: 14272 - protein, 15 aa, Artificial Sequence
  Description of Artificial Sequence: Synthetic peptide
WYLQKPGQSPQLLIY

SEQ ID NO: 14273 - protein, 15 aa, Artificial Sequence
  Description of Artificial Sequence: Synthetic peptide
WYLQKPGQSPQLLIY

SEQ ID NO: 14274 - protein, 15 aa, Artificial Sequence
  Description of Artificial Sequence: Synthetic peptide
WYLQKPGQSPQLLIY

SEQ ID NO: 14275 - protein, 15 aa, Artificial Sequence
  Description of Artificial Sequence: Synthetic peptide
WYLQKPGQSPQLLIY

SEQ ID NO: 14276 - protein, 15 aa, Artificial Sequence
  Description of Artificial Sequence: Synthetic peptide
WYLQKPGQSPQLLIY

SEQ ID NO: 14277 - protein, 15 aa, Artificial Sequence
  Description of Artificial Sequence: Synthetic peptide
WYLQKPGQSPQLLIY

SEQ ID NO: 14278 - protein, 15 aa, Artificial Sequence
  Description of Artificial Sequence: Synthetic peptide
WYQQKPGKVPKLLIY

SEQ ID NO: 14279 - protein, 15 aa, Artificial Sequence
  Description of Artificial Sequence: Synthetic peptide
WYQQKPGKVPKLLIY

SEQ ID NO: 14280 - protein, 15 aa, Artificial Sequence
  Description of Artificial Sequence: Synthetic peptide
WYQQKPGKVPNLLIY

SEQ ID NO: 14281 - protein, 15 aa, Artificial Sequence
  Description of Artificial Sequence: Synthetic peptide
WYQQKPGKVPKLLIY

SEQ ID NO: 14282 - protein, 15 aa, Artificial Sequence
  Description of Artificial Sequence: Synthetic peptide
WYQQKPGKVPKLLIS

SEQ ID NO: 14283 - protein, 15 aa, Artificial Sequence
  Description of Artificial Sequence: Synthetic peptide
WYQQKPGKVPKLLIY

SEQ ID NO: 14284 - protein, 15 aa, Artificial Sequence
  Description of Artificial Sequence: Synthetic peptide
WYQQKPGKVPKLLIY

SEQ ID NO: 14285 - protein, 15 aa, Artificial Sequence
  Description of Artificial Sequence: Synthetic peptide
WYLQKPGQSPQLLIY

SEQ ID NO: 14286 - protein, 15 aa, Artificial Sequence
  Description of Artificial Sequence: Synthetic peptide
WYLQKPGQSPQLLIY

SEQ ID NO: 14287 - protein, 15 aa, Artificial Sequence
  Description of Artificial Sequence: Synthetic peptide
WYQQKPGKVPKLLIY

SEQ ID NO: 14288 - protein, 15 aa, Artificial Sequence
  Description of Artificial Sequence: Synthetic peptide
WYQQKPGKVPKLLIY

SEQ ID NO: 14289 - protein, 15 aa, Artificial Sequence
  Description of Artificial Sequence: Synthetic peptide
WYLQKPGQSPQLLIY

SEQ ID NO: 14290 - protein, 15 aa, Artificial Sequence
  Description of Artificial Sequence: Synthetic peptide
WYLQKPGQSPQLLIY

SEQ ID NO: 14291 - protein, 15 aa, Artificial Sequence
  Description of Artificial Sequence: Synthetic peptide
WYQQKPGQPPKLLIY

SEQ ID NO: 14292 - protein, 15 aa, Artificial Sequence
  Description of Artificial Sequence: Synthetic peptide
WYQQKPGQPPKLLIY

SEQ ID NO: 14293 - protein, 15 aa, Artificial Sequence
  Description of Artificial Sequence: Synthetic peptide
WYQQKPGQPPKLLIY

SEQ ID NO: 14294 - protein, 15 aa, Artificial Sequence
  Description of Artificial Sequence: Synthetic peptide
WYQQKPGQPPKLLIY

SEQ ID NO: 14295 - protein, 15 aa, Artificial Sequence
  Description of Artificial Sequence: Synthetic peptide
WYQQKPGKAPKLLIY

SEQ ID NO: 14296 - protein, 15 aa, Artificial Sequence
  Description of Artificial Sequence: Synthetic peptide
WYQQKPGKAPKLLIY

SEQ ID NO: 14297 - protein, 15 aa, Artificial Sequence
  Description of Artificial Sequence: Synthetic peptide
WYQQKPGQPPKLLIY

SEQ ID NO: 14298 - protein, 15 aa, Artificial Sequence
  Description of Artificial Sequence: Synthetic peptide
WYQQKPGQPPKLLIY

SEQ ID NO: 14299 - protein, 15 aa, Artificial Sequence
  Description of Artificial Sequence: Synthetic peptide
WYQQKPGQPPKLLIY

SEQ ID NO: 14300 - protein, 15 aa, Artificial Sequence
  Description of Artificial Sequence: Synthetic peptide
WYQQKPGQPPKLLIY

SEQ ID NO: 14301 - protein, 15 aa, Artificial Sequence
  Description of Artificial Sequence: Synthetic peptide
WYQQKPGQPPKLLIY

SEQ ID NO: 14302 - protein, 15 aa, Artificial Sequence
  Description of Artificial Sequence: Synthetic peptide
WYQQKPGKAPKLLIY

SEQ ID NO: 14303 - protein, 15 aa, Artificial Sequence
  Description of Artificial Sequence: Synthetic peptide
WYQQKPGKAPKLLIY

SEQ ID NO: 14304 - protein, 15 aa, Artificial Sequence
  Description of Artificial Sequence: Synthetic peptide
WYQQKPGKAPKLLIY

SEQ ID NO: 14305 - protein, 15 aa, Artificial Sequence
  Description of Artificial Sequence: Synthetic peptide
WYQQKPGRAPKLLIF

SEQ ID NO: 14306 - protein, 15 aa, Artificial Sequence
  Description of Artificial Sequence: Synthetic peptide
WYQQKPGKAPKLLIY

SEQ ID NO: 14307 - protein, 15 aa, Artificial Sequence
  Description of Artificial Sequence: Synthetic peptide
WYQQKPGKAPKLLIY

SEQ ID NO: 14308 - protein, 15 aa, Artificial Sequence
  Description of Artificial Sequence: Synthetic peptide
WYQQKPGRAPKLLIF

SEQ ID NO: 14309 - protein, 15 aa, Artificial Sequence
  Description of Artificial Sequence: Synthetic peptide
WYQQKPGRAPKLLIF

SEQ ID NO: 14310 - protein, 15 aa, Artificial Sequence
  Description of Artificial Sequence: Synthetic peptide
WYQQKPGRAPKLLIF

SEQ ID NO: 14311 - protein, 15 aa, Artificial Sequence
  Description of Artificial Sequence: Synthetic peptide
WYQQKPGRAPKLLIF

SEQ ID NO: 14312 - protein, 15 aa, Artificial Sequence
  Description of Artificial Sequence: Synthetic peptide
WYQQKPGKAPKLLIY

SEQ ID NO: 14313 - protein, 15 aa, Artificial Sequence
  Description of Artificial Sequence: Synthetic peptide
WYQQKPGKAPKLLIY

SEQ ID NO: 14314 - protein, 15 aa, Artificial Sequence
  Description of Artificial Sequence: Synthetic peptide
WYQQKPGKAPKLLIY

SEQ ID NO: 14315 - protein, 15 aa, Artificial Sequence
  Description of Artificial Sequence: Synthetic peptide
WYQQKPGKAPKLLIY

SEQ ID NO: 14316 - protein, 15 aa, Artificial Sequence
  Description of Artificial Sequence: Synthetic peptide
WYQQKPGRAPKLLIF

SEQ ID NO: 14317 - protein, 15 aa, Artificial Sequence
  Description of Artificial Sequence: Synthetic peptide
WYQQKPGKAPKLLIY

SEQ ID NO: 14318 - protein, 15 aa, Artificial Sequence
  Description of Artificial Sequence: Synthetic peptide
WYQQKPGKAPKLLIY

SEQ ID NO: 14319 - protein, 15 aa, Artificial Sequence
  Description of Artificial Sequence: Synthetic peptide
WFQQKPGRAPKLLIF

SEQ ID NO: 14320 - protein, 15 aa, Artificial Sequence
  Description of Artificial Sequence: Synthetic peptide
WFQQKPGKAPKLLIY

SEQ ID NO: 14321 - protein, 15 aa, Artificial Sequence
  Description of Artificial Sequence: Synthetic peptide
WYQQKPGRAPKLLIF

SEQ ID NO: 14322 - protein, 15 aa, Artificial Sequence
  Description of Artificial Sequence: Synthetic peptide
WFQQKPGKAPKLLIF

SEQ ID NO: 14323 - protein, 15 aa, Artificial Sequence
  Description of Artificial Sequence: Synthetic peptide
WYQQKPGRAPKLLIF

SEQ ID NO: 14324 - protein, 15 aa, Artificial Sequence
  Description of Artificial Sequence: Synthetic peptide
WYQQKPGKAPKLLIY

SEQ ID NO: 14325 - protein, 15 aa, Artificial Sequence
  Description of Artificial Sequence: Synthetic peptide
WYQQKPGKAPKLLIY

SEQ ID NO: 14326 - protein, 15 aa, Artificial Sequence
  Description of Artificial Sequence: Synthetic peptide
WYQQKPGKAPKLLIY

SEQ ID NO: 14327 - protein, 15 aa, Artificial Sequence
  Description of Artificial Sequence: Synthetic peptide
WYQQKPGRAPKLLIF

SEQ ID NO: 14328 - protein, 15 aa, Artificial Sequence
  Description of Artificial Sequence: Synthetic peptide
WFQQKPGKAPKLLIF

SEQ ID NO: 14329 - protein, 15 aa, Artificial Sequence
  Description of Artificial Sequence: Synthetic peptide
WFQQKPGKAPKLLIF

SEQ ID NO: 14330 - protein, 15 aa, Artificial Sequence
  Description of Artificial Sequence: Synthetic peptide
WYQQKPGRAPKLLIF

SEQ ID NO: 14331 - protein, 15 aa, Artificial Sequence
  Description of Artificial Sequence: Synthetic peptide
WYQQKPGRAPKLLIF

SEQ ID NO: 14332 - protein, 15 aa, Artificial Sequence
  Description of Artificial Sequence: Synthetic peptide
WYQQKPGRAPKLLIF

SEQ ID NO: 14333 - protein, 15 aa, Artificial Sequence
  Description of Artificial Sequence: Synthetic peptide
WYQQKPGRAPKLLIF

SEQ ID NO: 14334 - protein, 15 aa, Artificial Sequence
  Description of Artificial Sequence: Synthetic peptide
WYQQKPGRAPKLLIF

SEQ ID NO: 14335 - protein, 15 aa, Artificial Sequence
  Description of Artificial Sequence: Synthetic peptide
WYQQKPGKAPKLLIY

SEQ ID NO: 14336 - protein, 15 aa, Artificial Sequence
  Description of Artificial Sequence: Synthetic peptide
WYQQKPGRAPKLLIF

SEQ ID NO: 14337 - protein, 15 aa, Artificial Sequence
  Description of Artificial Sequence: Synthetic peptide
WYQQKPGRAPKLLIF

SEQ ID NO: 14338 - protein, 15 aa, Artificial Sequence
  Description of Artificial Sequence: Synthetic peptide
WYQQKPGRAPKLLIF

SEQ ID NO: 14339 - protein, 15 aa, Artificial Sequence
  Description of Artificial Sequence: Synthetic peptide
WYQQKPGKAPKLLIY

SEQ ID NO: 14340 - protein, 15 aa, Artificial Sequence
  Description of Artificial Sequence: Synthetic peptide
WYQQKPGKAPKLLIY

SEQ ID NO: 14341 - protein, 15 aa, Artificial Sequence
  Description of Artificial Sequence: Synthetic peptide
WYQQKPGQAPRLLIY

SEQ ID NO: 14342 - protein, 15 aa, Artificial Sequence
  Description of Artificial Sequence: Synthetic peptide
WYLQKPGQSPQLLIY

SEQ ID NO: 14343 - protein, 15 aa, Artificial Sequence
  Description of Artificial Sequence: Synthetic peptide
WYQQKPGKVPKLLIY

SEQ ID NO: 14344 - protein, 15 aa, Artificial Sequence
  Description of Artificial Sequence: Synthetic peptide
WYQQKPGKVPKLLIS

SEQ ID NO: 14345 - protein, 15 aa, Artificial Sequence
  Description of Artificial Sequence: Synthetic peptide
WYQQKPGQPPKLLIY

SEQ ID NO: 14346 - protein, 15 aa, Artificial Sequence
  Description of Artificial Sequence: Synthetic peptide
WYQQKPGQPPKLLIY

SEQ ID NO: 14347 - protein, 15 aa, Artificial Sequence
  Description of Artificial Sequence: Synthetic peptide
WYQQKPGQPPKLLIY

SEQ ID NO: 14348 - protein, 15 aa, Artificial Sequence
  Description of Artificial Sequence: Synthetic peptide
WYQQKPGKAPKLLIY

SEQ ID NO: 14349 - protein, 15 aa, Artificial Sequence
  Description of Artificial Sequence: Synthetic peptide
WYQQKPGKAPKLLIY

SEQ ID NO: 14350 - protein, 15 aa, Artificial Sequence
  Description of Artificial Sequence: Synthetic peptide
WYQQHPGKAPKLMIY

SEQ ID NO: 14351 - protein, 15 aa, Artificial Sequence
  Description of Artificial Sequence: Synthetic peptide
WYQQHPGKAPKLMIY

SEQ ID NO: 14352 - protein, 15 aa, Artificial Sequence
  Description of Artificial Sequence: Synthetic peptide
WYQQLPGTAPKLLIY

SEQ ID NO: 14353 - protein, 15 aa, Artificial Sequence
  Description of Artificial Sequence: Synthetic peptide
WYQHLPGTAPKLLIY

SEQ ID NO: 14354 - protein, 15 aa, Artificial Sequence
  Description of Artificial Sequence: Synthetic peptide
WLQQHQGHPPKLLSY

SEQ ID NO: 14355 - protein, 15 aa, Artificial Sequence
  Description of Artificial Sequence: Synthetic peptide
WLQQHQGHPPKLLSY

SEQ ID NO: 14356 - protein, 15 aa, Artificial Sequence
  Description of Artificial Sequence: Synthetic peptide
WLQQHQGHPPKLLSY

SEQ ID NO: 14357 - protein, 15 aa, Artificial Sequence
  Description of Artificial Sequence: Synthetic peptide
WYQQHPGKAPKLMIY

SEQ ID NO: 14358 - protein, 15 aa, Artificial Sequence
  Description of Artificial Sequence: Synthetic peptide
WYQQHPGKAPKLMIY

SEQ ID NO: 14359 - protein, 15 aa, Artificial Sequence
  Description of Artificial Sequence: Synthetic peptide
WLQQHQGHPPKLLSY

SEQ ID NO: 14360 - protein, 15 aa, Artificial Sequence
  Description of Artificial Sequence: Synthetic peptide
WLQQHQGHPPKLLSY

SEQ ID NO: 14361 - protein, 15 aa, Artificial Sequence
  Description of Artificial Sequence: Synthetic peptide
WYQQKPGQAPVLVIY

SEQ ID NO: 14362 - protein, 15 aa, Artificial Sequence
  Description of Artificial Sequence: Synthetic peptide
WYQQKPGQAPVLVVY

SEQ ID NO: 14363 - protein, 15 aa, Artificial Sequence
  Description of Artificial Sequence: Synthetic peptide
WYQQKPGQAPVLVVY

SEQ ID NO: 14364 - protein, 15 aa, Artificial Sequence
  Description of Artificial Sequence: Synthetic peptide
WYQQKPGQAPVMVVY

SEQ ID NO: 14365 - protein, 15 aa, Artificial Sequence
  Description of Artificial Sequence: Synthetic peptide
WHQQKPGQAPVMVVY

SEQ ID NO: 14366 - protein, 15 aa, Artificial Sequence
  Description of Artificial Sequence: Synthetic peptide
WYQQKPGQAPVLVVY

SEQ ID NO: 14367 - protein, 15 aa, Artificial Sequence
  Description of Artificial Sequence: Synthetic peptide
WYQQKPGQAPVLVVY

SEQ ID NO: 14368 - protein, 15 aa, Artificial Sequence
  Description of Artificial Sequence: Synthetic peptide
WYQQKPGQAPVLVVY

SEQ ID NO: 14369 - protein, 15 aa, Artificial Sequence
  Description of Artificial Sequence: Synthetic peptide
WYQQKPGQAPVMVVY

SEQ ID NO: 14370 - protein, 15 aa, Artificial Sequence
  Description of Artificial Sequence: Synthetic peptide
WYQQKPGQAPVLVVY

SEQ ID NO: 14371 - protein, 15 aa, Artificial Sequence
  Description of Artificial Sequence: Synthetic peptide
WYQQKPGQAPVLVVY

SEQ ID NO: 14372 - protein, 15 aa, Artificial Sequence
  Description of Artificial Sequence: Synthetic peptide
WYQQKPGQAPVMVVY

SEQ ID NO: 14373 - protein, 15 aa, Artificial Sequence
  Description of Artificial Sequence: Synthetic peptide
WYQQKPGQAPVLVVY

SEQ ID NO: 14374 - protein, 15 aa, Artificial Sequence
  Description of Artificial Sequence: Synthetic peptide
WYQQKPGQAPVMVVY

SEQ ID NO: 14375 - protein, 15 aa, Artificial Sequence
  Description of Artificial Sequence: Synthetic peptide
WYQQKPGQAPVMVVY

SEQ ID NO: 14376 - protein, 15 aa, Artificial Sequence
  Description of Artificial Sequence: Synthetic peptide
WYQQKPGQAPVLVVY

SEQ ID NO: 14377 - protein, 15 aa, Artificial Sequence
  Description of Artificial Sequence: Synthetic peptide
WYQQKPGQAPVLVVY

SEQ ID NO: 14378 - protein, 15 aa, Artificial Sequence
  Description of Artificial Sequence: Synthetic peptide
WYQQKPGQAPVMVVY

SEQ ID NO: 14379 - protein, 15 aa, Artificial Sequence
  Description of Artificial Sequence: Synthetic peptide
WYQQKPGQAPVLVVY

SEQ ID NO: 14380 - protein, 15 aa, Artificial Sequence
  Description of Artificial Sequence: Synthetic peptide
WYQQKPGQSPVMVVY

SEQ ID NO: 14381 - protein, 15 aa, Artificial Sequence
  Description of Artificial Sequence: Synthetic peptide
WYQQKPGQAPVMVVY

SEQ ID NO: 14382 - protein, 15 aa, Artificial Sequence
  Description of Artificial Sequence: Synthetic peptide
WYQQKPGQAPVLVVY

SEQ ID NO: 14383 - protein, 15 aa, Artificial Sequence
  Description of Artificial Sequence: Synthetic peptide
WYQQKPGQAPVMVVY

SEQ ID NO: 14384 - protein, 15 aa, Artificial Sequence
  Description of Artificial Sequence: Synthetic peptide
WYQQKPGQAPVLVVY

SEQ ID NO: 14385 - protein, 15 aa, Artificial Sequence
  Description of Artificial Sequence: Synthetic peptide
WYQQKPGQAPVLVVY

SEQ ID NO: 14386 - protein, 15 aa, Artificial Sequence
  Description of Artificial Sequence: Synthetic peptide
WYQQKPGQAPVMVVY

SEQ ID NO: 14387 - protein, 15 aa, Artificial Sequence
  Description of Artificial Sequence: Synthetic peptide
WYQQKPGQAPVLVVY

SEQ ID NO: 14388 - protein, 15 aa, Artificial Sequence
  Description of Artificial Sequence: Synthetic peptide
WYQQKPGQAPVLVVY

SEQ ID NO: 14389 - protein, 15 aa, Artificial Sequence
  Description of Artificial Sequence: Synthetic peptide
WYQQKPGQAPVMVVY

SEQ ID NO: 14390 - protein, 15 aa, Artificial Sequence
  Description of Artificial Sequence: Synthetic peptide
WHQQKPGQAPVLVVY

SEQ ID NO: 14391 - protein, 15 aa, Artificial Sequence
  Description of Artificial Sequence: Synthetic peptide
WYQQKPGQAPVLVVY

SEQ ID NO: 14392 - protein, 15 aa, Artificial Sequence
  Description of Artificial Sequence: Synthetic peptide
WYQQKPGQAPVMVVY

SEQ ID NO: 14393 - protein, 15 aa, Artificial Sequence
  Description of Artificial Sequence: Synthetic peptide
WYQQKPGQAPVLVVY

SEQ ID NO: 14394 - protein, 15 aa, Artificial Sequence
  Description of Artificial Sequence: Synthetic peptide
WYQQKPGQAPVLVVY

SEQ ID NO: 14395 - protein, 15 aa, Artificial Sequence
  Description of Artificial Sequence: Synthetic peptide
WHQQKPGQAPVLVVY

SEQ ID NO: 14396 - protein, 15 aa, Artificial Sequence
  Description of Artificial Sequence: Synthetic peptide
WYQQKPGQAPVLVVY

SEQ ID NO: 14397 - protein, 15 aa, Artificial Sequence
  Description of Artificial Sequence: Synthetic peptide
WYQQKPGQAPVLVVY

SEQ ID NO: 14398 - protein, 15 aa, Artificial Sequence
  Description of Artificial Sequence: Synthetic peptide
WHQQKPGQAPVLVVY

SEQ ID NO: 14399 - protein, 15 aa, Artificial Sequence
  Description of Artificial Sequence: Synthetic peptide
WYQQKPGQAPVLVVY

SEQ ID NO: 14400 - protein, 15 aa, Artificial Sequence
  Description of Artificial Sequence: Synthetic peptide
WHQQKPGQSPVLVIY

SEQ ID NO: 14401 - protein, 15 aa, Artificial Sequence
  Description of Artificial Sequence: Synthetic peptide
WYQQKPGQAPVMVVY

SEQ ID NO: 14402 - protein, 15 aa, Artificial Sequence
  Description of Artificial Sequence: Synthetic peptide
WYQQKPGQAPVLVVY

SEQ ID NO: 14403 - protein, 15 aa, Artificial Sequence
  Description of Artificial Sequence: Synthetic peptide
WYQQKPGQAPVMVVY

SEQ ID NO: 14404 - protein, 15 aa, Artificial Sequence
  Description of Artificial Sequence: Synthetic peptide
WHQQKPGQAPVLVVY

SEQ ID NO: 14405 - protein, 15 aa, Artificial Sequence
  Description of Artificial Sequence: Synthetic peptide
WHQQKPGQAPVLVVY

SEQ ID NO: 14406 - protein, 15 aa, Artificial Sequence
  Description of Artificial Sequence: Synthetic peptide
WHQQKPGQAPVLVVY

SEQ ID NO: 14407 - protein, 15 aa, Artificial Sequence
  Description of Artificial Sequence: Synthetic peptide
WYQQKPGQAPVLVVY

SEQ ID NO: 14408 - protein, 15 aa, Artificial Sequence
  Description of Artificial Sequence: Synthetic peptide
WYQQKPGQAPVMVVY

SEQ ID NO: 14409 - protein, 15 aa, Artificial Sequence
  Description of Artificial Sequence: Synthetic peptide
WYQQKPGQAPVMVVY

SEQ ID NO: 14410 - protein, 15 aa, Artificial Sequence
  Description of Artificial Sequence: Synthetic peptide
WYQQKPGQAPVMVVY

SEQ ID NO: 14411 - protein, 15 aa, Artificial Sequence
  Description of Artificial Sequence: Synthetic peptide
WYQQKPGQAPVLVVY

SEQ ID NO: 14412 - protein, 15 aa, Artificial Sequence
  Description of Artificial Sequence: Synthetic peptide
WYQQKPGQAPVMVVY

SEQ ID NO: 14413 - protein, 15 aa, Artificial Sequence
  Description of Artificial Sequence: Synthetic peptide
WYQQKPGQAPVMVVY

SEQ ID NO: 14414 - protein, 15 aa, Artificial Sequence
  Description of Artificial Sequence: Synthetic peptide
WYQQKPGQAPVMVVY

SEQ ID NO: 14415 - protein, 15 aa, Artificial Sequence
  Description of Artificial Sequence: Synthetic peptide
WYQQKPGQAPVMVVY

SEQ ID NO: 14416 - protein, 15 aa, Artificial Sequence
  Description of Artificial Sequence: Synthetic peptide
WYQQKPGQAPVMVVY

SEQ ID NO: 14417 - protein, 15 aa, Artificial Sequence
  Description of Artificial Sequence: Synthetic peptide
WYQQKPGQAPVMVVY

SEQ ID NO: 14418 - protein, 15 aa, Artificial Sequence
  Description of Artificial Sequence: Synthetic peptide
WYQQKPGQAPVMVVY

SEQ ID NO: 14419 - protein, 15 aa, Artificial Sequence
  Description of Artificial Sequence: Synthetic peptide
WYQQKPGQAPVMVVY

SEQ ID NO: 14420 - protein, 15 aa, Artificial Sequence
  Description of Artificial Sequence: Synthetic peptide
WYQQKPGQAPVLVIY

SEQ ID NO: 14421 - protein, 15 aa, Artificial Sequence
  Description of Artificial Sequence: Synthetic peptide
WYQQKPGQAPVMVVY

SEQ ID NO: 14422 - protein, 15 aa, Artificial Sequence
  Description of Artificial Sequence: Synthetic peptide
WYQQKPGQAPVMVVY

SEQ ID NO: 14423 - protein, 14 aa, Artificial Sequence
  Description of Artificial Sequence: Synthetic peptide
WVQQAPGKGLEWMG

SEQ ID NO: 14424 - protein, 14 aa, Artificial Sequence
  Description of Artificial Sequence: Synthetic peptide
WVKQRPGKGLEWIG

SEQ ID NO: 14425 - protein, 14 aa, Artificial Sequence
  Description of Artificial Sequence: Synthetic peptide
WVRQAPGQGLEWMG

SEQ ID NO: 14426 - protein, 14 aa, Artificial Sequence
  Description of Artificial Sequence: Synthetic peptide
WVKQRPGEGLEWIG

SEQ ID NO: 14427 - protein, 14 aa, Artificial Sequence
  Description of Artificial Sequence: Synthetic peptide
WVRQAPGQGLEWMG

SEQ ID NO: 14428 - protein, 14 aa, Artificial Sequence
  Description of Artificial Sequence: Synthetic peptide
WVKQRPGKGLEWIG

SEQ ID NO: 14429 - protein, 14 aa, Artificial Sequence
  Description of Artificial Sequence: Synthetic peptide
WVRQATGQGLEWMG

SEQ ID NO: 14430 - protein, 14 aa, Artificial Sequence
  Description of Artificial Sequence: Synthetic peptide
WVRQATGQGLEWMG

SEQ ID NO: 14431 - protein, 14 aa, Artificial Sequence
  Description of Artificial Sequence: Synthetic peptide
WVRQATGQGLEWMG

SEQ ID NO: 14432 - protein, 14 aa, Artificial Sequence
  Description of Artificial Sequence: Synthetic peptide
WVRQATGQGLEWMG

SEQ ID NO: 14433 - protein, 14 aa, Artificial Sequence
  Description of Artificial Sequence: Synthetic peptide
WVRQATGQGLEWMG

SEQ ID NO: 14434 - protein, 14 aa, Artificial Sequence
  Description of Artificial Sequence: Synthetic peptide
WVRQATGQGLEWMG

SEQ ID NO: 14435 - protein, 14 aa, Artificial Sequence
  Description of Artificial Sequence: Synthetic peptide
WVRQATGQGLEWMG

SEQ ID NO: 14436 - protein, 14 aa, Artificial Sequence
  Description of Artificial Sequence: Synthetic peptide
WIRQPPGKGLEWIG

SEQ ID NO: 14437 - protein, 14 aa, Artificial Sequence
  Description of Artificial Sequence: Synthetic peptide
WIRQPPGKGLEWIG

SEQ ID NO: 14438 - protein, 14 aa, Artificial Sequence
  Description of Artificial Sequence: Synthetic peptide
WIRQPPGKGLEWIG

SEQ ID NO: 14439 - protein, 14 aa, Artificial Sequence
  Description of Artificial Sequence: Synthetic peptide
WIRQPPGKGLEWIG

SEQ ID NO: 14440 - protein, 14 aa, Artificial Sequence
  Description of Artificial Sequence: Synthetic peptide
WIRQPPGKGLEWIG

SEQ ID NO: 14441 - protein, 14 aa, Artificial Sequence
  Description of Artificial Sequence: Synthetic peptide
WIRQPPGKGLEWIG

SEQ ID NO: 14442 - protein, 14 aa, Artificial Sequence
  Description of Artificial Sequence: Synthetic peptide
WIRQPPGKGLEWIG

SEQ ID NO: 14443 - protein, 14 aa, Artificial Sequence
  Description of Artificial Sequence: Synthetic peptide
WIRQPPGKGLEWIG

SEQ ID NO: 14444 - protein, 14 aa, Artificial Sequence
  Description of Artificial Sequence: Synthetic peptide
WIRQPPGKGLEWIG

SEQ ID NO: 14445 - protein, 14 aa, Artificial Sequence
  Description of Artificial Sequence: Synthetic peptide
WIRQPPGKGLEWIG

SEQ ID NO: 14446 - protein, 14 aa, Artificial Sequence
  Description of Artificial Sequence: Synthetic peptide
WIRQPPGKGLEWIG

SEQ ID NO: 14447 - protein, 14 aa, Artificial Sequence
  Description of Artificial Sequence: Synthetic peptide
WVRQAPGKGLEWVS

SEQ ID NO: 14448 - protein, 14 aa, Artificial Sequence
  Description of Artificial Sequence: Synthetic peptide
WVRQAPGKGLEWVS

SEQ ID NO: 14449 - protein, 14 aa, Artificial Sequence
  Description of Artificial Sequence: Synthetic peptide
WVRQAPGKGLEWVS

SEQ ID NO: 14450 - protein, 14 aa, Artificial Sequence
  Description of Artificial Sequence: Synthetic peptide
WVRQAPGKGLEWVS

SEQ ID NO: 14451 - protein, 14 aa, Artificial Sequence
  Description of Artificial Sequence: Synthetic peptide
WVRQAPGKGLEWVS

SEQ ID NO: 14452 - protein, 14 aa, Artificial Sequence
  Description of Artificial Sequence: Synthetic peptide
WVRQAPGKGLEWVS

SEQ ID NO: 14453 - protein, 14 aa, Artificial Sequence
  Description of Artificial Sequence: Synthetic peptide
WVRQAPGKGLEWVA

SEQ ID NO: 14454 - protein, 14 aa, Artificial Sequence
  Description of Artificial Sequence: Synthetic peptide
WVRQAPGKGLEWVA

SEQ ID NO: 14455 - protein, 14 aa, Artificial Sequence
  Description of Artificial Sequence: Synthetic peptide
WVRQAPGKGLEWVA

SEQ ID NO: 14456 - protein, 14 aa, Artificial Sequence
  Description of Artificial Sequence: Synthetic peptide
WIRQPPGKGLEWIG

SEQ ID NO: 14457 - protein, 14 aa, Artificial Sequence
  Description of Artificial Sequence: Synthetic peptide
WIRQPPGKGLEWIG

SEQ ID NO: 14458 - protein, 14 aa, Artificial Sequence
  Description of Artificial Sequence: Synthetic peptide
WIRQPPGKGLEWIG

SEQ ID NO: 14459 - protein, 14 aa, Artificial Sequence
  Description of Artificial Sequence: Synthetic peptide
WIRQPPGKGLEWIG

SEQ ID NO: 14460 - protein, 14 aa, Artificial Sequence
  Description of Artificial Sequence: Synthetic peptide
WIRQPPGKGLEWIG

SEQ ID NO: 14461 - protein, 14 aa, Artificial Sequence
  Description of Artificial Sequence: Synthetic peptide
WIRQPPGKGLEWIG

SEQ ID NO: 14462 - protein, 14 aa, Artificial Sequence
  Description of Artificial Sequence: Synthetic peptide
WIRQPPGKGLEWIG

SEQ ID NO: 14463 - protein, 14 aa, Artificial Sequence
  Description of Artificial Sequence: Synthetic peptide
WIRQPPGKGLEWIG

SEQ ID NO: 14464 - protein, 14 aa, Artificial Sequence
  Description of Artificial Sequence: Synthetic peptide
WIRQPPGKGLEWIG

SEQ ID NO: 14465 - protein, 14 aa, Artificial Sequence
  Description of Artificial Sequence: Synthetic peptide
WIRQPPGKGLEWIG

SEQ ID NO: 14466 - protein, 14 aa, Artificial Sequence
  Description of Artificial Sequence: Synthetic peptide
WVRQAPGKGLEWVS

SEQ ID NO: 14467 - protein, 14 aa, Artificial Sequence
  Description of Artificial Sequence: Synthetic peptide
WVRQAPGRGLEWVS

SEQ ID NO: 14468 - protein, 14 aa, Artificial Sequence
  Description of Artificial Sequence: Synthetic peptide
WVRQAPGRGLEWVS

SEQ ID NO: 14469 - protein, 14 aa, Artificial Sequence
  Description of Artificial Sequence: Synthetic peptide
WVRQAPGKGLEWVS

SEQ ID NO: 14470 - protein, 14 aa, Artificial Sequence
  Description of Artificial Sequence: Synthetic peptide
WVRQAPGRGLEWVS

SEQ ID NO: 14471 - protein, 14 aa, Artificial Sequence
  Description of Artificial Sequence: Synthetic peptide
WVRQAPGKGLEWVS

SEQ ID NO: 14472 - protein, 14 aa, Artificial Sequence
  Description of Artificial Sequence: Synthetic peptide
WVRQAPGKGLEWVS

SEQ ID NO: 14473 - protein, 14 aa, Artificial Sequence
  Description of Artificial Sequence: Synthetic peptide
WVRQAPGKGLEWVS

SEQ ID NO: 14474 - protein, 14 aa, Artificial Sequence
  Description of Artificial Sequence: Synthetic peptide
WVRQAPGKGLEWVS

SEQ ID NO: 14475 - protein, 14 aa, Artificial Sequence
  Description of Artificial Sequence: Synthetic peptide
WVRQAPGKGLEWVS

SEQ ID NO: 14476 - protein, 14 aa, Artificial Sequence
  Description of Artificial Sequence: Synthetic peptide
WVRQAPGKGLEWVS

SEQ ID NO: 14477 - protein, 14 aa, Artificial Sequence
  Description of Artificial Sequence: Synthetic peptide
WVRQAPGKGLEWVS

SEQ ID NO: 14478 - protein, 14 aa, Artificial Sequence
  Description of Artificial Sequence: Synthetic peptide
WVRQAPGKGLEWVS

SEQ ID NO: 14479 - protein, 14 aa, Artificial Sequence
  Description of Artificial Sequence: Synthetic peptide
WIRQHPGKGLEWIG

SEQ ID NO: 14480 - protein, 14 aa, Artificial Sequence
  Description of Artificial Sequence: Synthetic peptide
WIRQHPGKGLEWIG

SEQ ID NO: 14481 - protein, 14 aa, Artificial Sequence
  Description of Artificial Sequence: Synthetic peptide
WIRQHPGKGLEWIG

SEQ ID NO: 14482 - protein, 14 aa, Artificial Sequence
  Description of Artificial Sequence: Synthetic peptide
WIRQLPGKGLEWIG

SEQ ID NO: 14483 - protein, 14 aa, Artificial Sequence
  Description of Artificial Sequence: Synthetic peptide
WIRQHPGKGLEWIG

SEQ ID NO: 14484 - protein, 14 aa, Artificial Sequence
  Description of Artificial Sequence: Synthetic peptide
WIRQHPGKGLEWIG

SEQ ID NO: 14485 - protein, 14 aa, Artificial Sequence
  Description of Artificial Sequence: Synthetic peptide
WIRQHPGKGLEWIG

SEQ ID NO: 14486 - protein, 14 aa, Artificial Sequence
  Description of Artificial Sequence: Synthetic peptide
WIRQHPGKGLEWIG

SEQ ID NO: 14487 - protein, 14 aa, Artificial Sequence
  Description of Artificial Sequence: Synthetic peptide
WIRQHPGKGLEWIG

SEQ ID NO: 14488 - protein, 14 aa, Artificial Sequence
  Description of Artificial Sequence: Synthetic peptide
WIRQLPGKGLEWIG

SEQ ID NO: 14489 - protein, 14 aa, Artificial Sequence
  Description of Artificial Sequence: Synthetic peptide
WIRQHPGKGLEWIG

SEQ ID NO: 14490 - protein, 14 aa, Artificial Sequence
  Description of Artificial Sequence: Synthetic peptide
WIRQHPGKGLEWIG

SEQ ID NO: 14491 - protein, 14 aa, Artificial Sequence
  Description of Artificial Sequence: Synthetic peptide
WIRQHPGMGLEWIG

SEQ ID NO: 14492 - protein, 14 aa, Artificial Sequence
  Description of Artificial Sequence: Synthetic peptide
WIRQHPGKGLEWIG

SEQ ID NO: 14493 - protein, 14 aa, Artificial Sequence
  Description of Artificial Sequence: Synthetic peptide
WIRQHPGKGLEWIG

SEQ ID NO: 14494 - protein, 14 aa, Artificial Sequence
  Description of Artificial Sequence: Synthetic peptide
WIRQHPGKGLEWIG

SEQ ID NO: 14495 - protein, 14 aa, Artificial Sequence
  Description of Artificial Sequence: Synthetic peptide
WIRQLPGKGLEWIG

SEQ ID NO: 14496 - protein, 14 aa, Artificial Sequence
  Description of Artificial Sequence: Synthetic peptide
WIRQHPGKGLEWIG

SEQ ID NO: 14497 - protein, 14 aa, Artificial Sequence
  Description of Artificial Sequence: Synthetic peptide
WIRQLPGKGLEWIG

SEQ ID NO: 14498 - protein, 14 aa, Artificial Sequence
  Description of Artificial Sequence: Synthetic peptide
WVRQAPGKGLEWVS

SEQ ID NO: 14499 - protein, 14 aa, Artificial Sequence
  Description of Artificial Sequence: Synthetic peptide
WVRQAPGKGLEWVS

SEQ ID NO: 14500 - protein, 14 aa, Artificial Sequence
  Description of Artificial Sequence: Synthetic peptide
WVRQAPGKGLEWVA

SEQ ID NO: 14501 - protein, 14 aa, Artificial Sequence
  Description of Artificial Sequence: Synthetic peptide
WVRQAPGKGLEWVA

SEQ ID NO: 14502 - protein, 14 aa, Artificial Sequence
  Description of Artificial Sequence: Synthetic peptide
WVRQAPGKGLEWVA

SEQ ID NO: 14503 - protein, 14 aa, Artificial Sequence
  Description of Artificial Sequence: Synthetic peptide
WVRQATGQGLEWMG

SEQ ID NO: 14504 - protein, 14 aa, Artificial Sequence
  Description of Artificial Sequence: Synthetic peptide
WVRQATGQGLEWMG

SEQ ID NO: 14505 - protein, 14 aa, Artificial Sequence
  Description of Artificial Sequence: Synthetic peptide
WVRQATGQGLEWMG

SEQ ID NO: 14506 - protein, 14 aa, Artificial Sequence
  Description of Artificial Sequence: Synthetic peptide
WVRQATGQGLEWMG

SEQ ID NO: 14507 - protein, 14 aa, Artificial Sequence
  Description of Artificial Sequence: Synthetic peptide
WVRQATGQGLEWMG

SEQ ID NO: 14508 - protein, 14 aa, Artificial Sequence
  Description of Artificial Sequence: Synthetic peptide
WVRQATGQGLEWMG

SEQ ID NO: 14509 - protein, 14 aa, Artificial Sequence
  Description of Artificial Sequence: Synthetic peptide
WVRQAPGKGLEWVS

SEQ ID NO: 14510 - protein, 14 aa, Artificial Sequence
  Description of Artificial Sequence: Synthetic peptide
WVRQAPGKGLEWVS

SEQ ID NO: 14511 - protein, 14 aa, Artificial Sequence
  Description of Artificial Sequence: Synthetic peptide
WVRQAPGKGLEWVA

SEQ ID NO: 14512 - protein, 14 aa, Artificial Sequence
  Description of Artificial Sequence: Synthetic peptide
WVRQAPGKGLEWVA

SEQ ID NO: 14513 - protein, 14 aa, Artificial Sequence
  Description of Artificial Sequence: Synthetic peptide
WVRQAPGKGLEWVA

SEQ ID NO: 14514 - protein, 14 aa, Artificial Sequence
  Description of Artificial Sequence: Synthetic peptide
WIRQPPGKGLEWIG

SEQ ID NO: 14515 - protein, 14 aa, Artificial Sequence
  Description of Artificial Sequence: Synthetic peptide
WIRQPPGKGLEWIG

SEQ ID NO: 14516 - protein, 14 aa, Artificial Sequence
  Description of Artificial Sequence: Synthetic peptide
WIRQPPGKGLEWIG

SEQ ID NO: 14517 - protein, 14 aa, Artificial Sequence
  Description of Artificial Sequence: Synthetic peptide
WIRQPPGKGLEWIG

SEQ ID NO: 14518 - protein, 14 aa, Artificial Sequence
  Description of Artificial Sequence: Synthetic peptide
WIRQPPGKGLEWIG

SEQ ID NO: 14519 - protein, 14 aa, Artificial Sequence
  Description of Artificial Sequence: Synthetic peptide
WIRQSPSRGLEWLG

SEQ ID NO: 14520 - protein, 14 aa, Artificial Sequence
  Description of Artificial Sequence: Synthetic peptide
WIRQSPSRGLEWLG

SEQ ID NO: 14521 - protein, 14 aa, Artificial Sequence
  Description of Artificial Sequence: Synthetic peptide
WIRQPPGKGLEWIG

SEQ ID NO: 14522 - protein, 14 aa, Artificial Sequence
  Description of Artificial Sequence: Synthetic peptide
WIRQPPGKGLEWIG

SEQ ID NO: 14523 - protein, 14 aa, Artificial Sequence
  Description of Artificial Sequence: Synthetic peptide
WIRQPPGKALEWLA

SEQ ID NO: 14524 - protein, 14 aa, Artificial Sequence
  Description of Artificial Sequence: Synthetic peptide
WIRQPPGKALEWLA

SEQ ID NO: 14525 - protein, 14 aa, Artificial Sequence
  Description of Artificial Sequence: Synthetic peptide
WIRQPPGKALEWLA

SEQ ID NO: 14526 - protein, 14 aa, Artificial Sequence
  Description of Artificial Sequence: Synthetic peptide
WIRQPPGKALEWLA

SEQ ID NO: 14527 - protein, 14 aa, Artificial Sequence
  Description of Artificial Sequence: Synthetic peptide
WVRQAPGKGLEWVS

SEQ ID NO: 14528 - protein, 14 aa, Artificial Sequence
  Description of Artificial Sequence: Synthetic peptide
WVRQAPGKGLEWVS

SEQ ID NO: 14529 - protein, 14 aa, Artificial Sequence
  Description of Artificial Sequence: Synthetic peptide
WIRQPPGKGLEWIG

SEQ ID NO: 14530 - protein, 14 aa, Artificial Sequence
  Description of Artificial Sequence: Synthetic peptide
WIRQPPGKGLEWIG

SEQ ID NO: 14531 - protein, 14 aa, Artificial Sequence
  Description of Artificial Sequence: Synthetic peptide
WIRQPPGKALEWLA

SEQ ID NO: 14532 - protein, 14 aa, Artificial Sequence
  Description of Artificial Sequence: Synthetic peptide
WIRQPPGKALEWLA

SEQ ID NO: 14533 - protein, 14 aa, Artificial Sequence
  Description of Artificial Sequence: Synthetic peptide
WIRQPPGKALEWLA

SEQ ID NO: 14534 - protein, 14 aa, Artificial Sequence
  Description of Artificial Sequence: Synthetic peptide
WIRQPPGKALEWLA

SEQ ID NO: 14535 - protein, 14 aa, Artificial Sequence
  Description of Artificial Sequence: Synthetic peptide
WIRQPPGKALEWLA

SEQ ID NO: 14536 - protein, 14 aa, Artificial Sequence
  Description of Artificial Sequence: Synthetic peptide
WIRQPPGKALEWLA

SEQ ID NO: 14537 - protein, 14 aa, Artificial Sequence
  Description of Artificial Sequence: Synthetic peptide
WIRQPPGKALEWLA

SEQ ID NO: 14538 - protein, 14 aa, Artificial Sequence
  Description of Artificial Sequence: Synthetic peptide
WIRQPPGKALEWLA

SEQ ID NO: 14539 - protein, 14 aa, Artificial Sequence
  Description of Artificial Sequence: Synthetic peptide
WIRQPPGKALEWLA

SEQ ID NO: 14540 - protein, 14 aa, Artificial Sequence
  Description of Artificial Sequence: Synthetic peptide
WIRQPPGKALEWLA

SEQ ID NO: 14541 - protein, 14 aa, Artificial Sequence
  Description of Artificial Sequence: Synthetic peptide
WIRQPPGKALEWLA

SEQ ID NO: 14542 - protein, 14 aa, Artificial Sequence
  Description of Artificial Sequence: Synthetic peptide
WVRQAPGKGLEWVS

SEQ ID NO: 14543 - protein, 14 aa, Artificial Sequence
  Description of Artificial Sequence: Synthetic peptide
WVRQAPGKGLEWVS

SEQ ID NO: 14544 - protein, 14 aa, Artificial Sequence
  Description of Artificial Sequence: Synthetic peptide
WVRQAPGKGLEWVS

SEQ ID NO: 14545 - protein, 14 aa, Artificial Sequence
  Description of Artificial Sequence: Synthetic peptide
WIRQHPGKGLEWIG

SEQ ID NO: 14546 - protein, 14 aa, Artificial Sequence
  Description of Artificial Sequence: Synthetic peptide
WIRQHPGKGLEWIG

SEQ ID NO: 14547 - protein, 14 aa, Artificial Sequence
  Description of Artificial Sequence: Synthetic peptide
WIRQHPGKGLEWIG

SEQ ID NO: 14548 - protein, 14 aa, Artificial Sequence
  Description of Artificial Sequence: Synthetic peptide
WIRQHPGKGLEWIG

SEQ ID NO: 14549 - protein, 14 aa, Artificial Sequence
  Description of Artificial Sequence: Synthetic peptide
WIRQHPGKGLEWIG

SEQ ID NO: 14550 - protein, 14 aa, Artificial Sequence
  Description of Artificial Sequence: Synthetic peptide
WIRQHPGKGLEWIG

SEQ ID NO: 14551 - protein, 14 aa, Artificial Sequence
  Description of Artificial Sequence: Synthetic peptide
WIRQHPGKGLEWIG

SEQ ID NO: 14552 - protein, 14 aa, Artificial Sequence
  Description of Artificial Sequence: Synthetic peptide
WVRQAPGKGLEWVG

SEQ ID NO: 14553 - protein, 14 aa, Artificial Sequence
  Description of Artificial Sequence: Synthetic peptide
WVRQAPGKGLEWVG

SEQ ID NO: 14554 - protein, 14 aa, Artificial Sequence
  Description of Artificial Sequence: Synthetic peptide
WVRQAPGKGLEWVG

SEQ ID NO: 14555 - protein, 14 aa, Artificial Sequence
  Description of Artificial Sequence: Synthetic peptide
WVRQAPGKGLEWVG

SEQ ID NO: 14556 - protein, 14 aa, Artificial Sequence
  Description of Artificial Sequence: Synthetic peptide
WVRQAPGKGLEWVG

SEQ ID NO: 14557 - protein, 14 aa, Artificial Sequence
  Description of Artificial Sequence: Synthetic peptide
WVRQAPGKGLEWVG

SEQ ID NO: 14558 - protein, 14 aa, Artificial Sequence
  Description of Artificial Sequence: Synthetic peptide
WVRQAPGKGLEWVG

SEQ ID NO: 14559 - protein, 14 aa, Artificial Sequence
  Description of Artificial Sequence: Synthetic peptide
WVRQAPGKGLEWVG

SEQ ID NO: 14560 - protein, 14 aa, Artificial Sequence
  Description of Artificial Sequence: Synthetic peptide
WVRQAPGKGLEWVG

SEQ ID NO: 14561 - protein, 14 aa, Artificial Sequence
  Description of Artificial Sequence: Synthetic peptide
WVRQAPGKGLEWVG

SEQ ID NO: 14562 - protein, 14 aa, Artificial Sequence
  Description of Artificial Sequence: Synthetic peptide
WVRQAPGKGLEWVG

SEQ ID NO: 14563 - protein, 14 aa, Artificial Sequence
  Description of Artificial Sequence: Synthetic peptide
WVRQAPGKGLEWVG

SEQ ID NO: 14564 - protein, 14 aa, Artificial Sequence
  Description of Artificial Sequence: Synthetic peptide
WVRQAPGKGLEWVG

SEQ ID NO: 14565 - protein, 14 aa, Artificial Sequence
  Description of Artificial Sequence: Synthetic peptide
WVRQAPGKGLEWVG

SEQ ID NO: 14566 - protein, 14 aa, Artificial Sequence
  Description of Artificial Sequence: Synthetic peptide
WVRQAPGKGLEWVG

SEQ ID NO: 14567 - protein, 14 aa, Artificial Sequence
  Description of Artificial Sequence: Synthetic peptide
WVRQAPGKGLEWVG

SEQ ID NO: 14568 - protein, 14 aa, Artificial Sequence
  Description of Artificial Sequence: Synthetic peptide
WVRQAPGKGLEWVG

SEQ ID NO: 14569 - protein, 14 aa, Artificial Sequence
  Description of Artificial Sequence: Synthetic peptide
WVRQAPGKGLEWVG

SEQ ID NO: 14570 - protein, 14 aa, Artificial Sequence
  Description of Artificial Sequence: Synthetic peptide
WVRQAPGKGLEWVG

SEQ ID NO: 14571 - protein, 14 aa, Artificial Sequence
  Description of Artificial Sequence: Synthetic peptide
WVRQAPGKGLEWVG

SEQ ID NO: 14572 - protein, 14 aa, Artificial Sequence
  Description of Artificial Sequence: Synthetic peptide
WVRQAPGKGLEWVG

SEQ ID NO: 14573 - protein, 14 aa, Artificial Sequence
  Description of Artificial Sequence: Synthetic peptide
WVRQAPGKGLEWVG

SEQ ID NO: 14574 - protein, 14 aa, Artificial Sequence
  Description of Artificial Sequence: Synthetic peptide
WVRQAPGKGLEWVG

SEQ ID NO: 14575 - protein, 14 aa, Artificial Sequence
  Description of Artificial Sequence: Synthetic peptide
WVRQAPGKGLEWVG

SEQ ID NO: 14576 - protein, 14 aa, Artificial Sequence
  Description of Artificial Sequence: Synthetic peptide
WIRQPPGKGLEWIG

SEQ ID NO: 14577 - protein, 14 aa, Artificial Sequence
  Description of Artificial Sequence: Synthetic peptide
WIRQPAGKGLEWIG

SEQ ID NO: 14578 - protein, 14 aa, Artificial Sequence
  Description of Artificial Sequence: Synthetic peptide
WIRQPPGKGLEWIG

SEQ ID NO: 14579 - protein, 14 aa, Artificial Sequence
  Description of Artificial Sequence: Synthetic peptide
WVRQPAGKGLEWIG

SEQ ID NO: 14580 - protein, 14 aa, Artificial Sequence
  Description of Artificial Sequence: Synthetic peptide
WVRQAPGKGLEWVS

SEQ ID NO: 14581 - protein, 14 aa, Artificial Sequence
  Description of Artificial Sequence: Synthetic peptide
WVRQAPGKGLEWVS

SEQ ID NO: 14582 - protein, 14 aa, Artificial Sequence
  Description of Artificial Sequence: Synthetic peptide
WVRQAPGKGLEWVS

SEQ ID NO: 14583 - protein, 14 aa, Artificial Sequence
  Description of Artificial Sequence: Synthetic peptide
WVRQAPGKGLEWVS

SEQ ID NO: 14584 - protein, 14 aa, Artificial Sequence
  Description of Artificial Sequence: Synthetic peptide
WVRQAPGKGLEWVS

SEQ ID NO: 14585 - protein, 14 aa, Artificial Sequence
  Description of Artificial Sequence: Synthetic peptide
WVRQAPGKGLEWVS

SEQ ID NO: 14586 - protein, 14 aa, Artificial Sequence
  Description of Artificial Sequence: Synthetic peptide
WVRQAPGKGLEWVS

SEQ ID NO: 14587 - protein, 14 aa, Artificial Sequence
  Description of Artificial Sequence: Synthetic peptide
WVRQAPGKGLEWVS

SEQ ID NO: 14588 - protein, 14 aa, Artificial Sequence
  Description of Artificial Sequence: Synthetic peptide
WVRQAPGKGLEWVS

SEQ ID NO: 14589 - protein, 14 aa, Artificial Sequence
  Description of Artificial Sequence: Synthetic peptide
WVRQAPGKGLEWVS

SEQ ID NO: 14590 - protein, 14 aa, Artificial Sequence
  Description of Artificial Sequence: Synthetic peptide
WVRQAPGKGLEWVS

SEQ ID NO: 14591 - protein, 14 aa, Artificial Sequence
  Description of Artificial Sequence: Synthetic peptide
WVRQAPGKGLEWVS

SEQ ID NO: 14592 - protein, 14 aa, Artificial Sequence
  Description of Artificial Sequence: Synthetic peptide
WVRQAPGKGLEWVS

SEQ ID NO: 14593 - protein, 14 aa, Artificial Sequence
  Description of Artificial Sequence: Synthetic peptide
WVRQAPGKGLEWVS

SEQ ID NO: 14594 - protein, 14 aa, Artificial Sequence
  Description of Artificial Sequence: Synthetic peptide
WVRQAPGKGLEWVS

SEQ ID NO: 14595 - protein, 14 aa, Artificial Sequence
  Description of Artificial Sequence: Synthetic peptide
WVRQAPGKGLEWVS

SEQ ID NO: 14596 - protein, 14 aa, Artificial Sequence
  Description of Artificial Sequence: Synthetic peptide
WVRQAPGKGLEWVS

SEQ ID NO: 14597 - protein, 14 aa, Artificial Sequence
  Description of Artificial Sequence: Synthetic peptide
WVRQAPGKGLEWVS

SEQ ID NO: 14598 - protein, 14 aa, Artificial Sequence
  Description of Artificial Sequence: Synthetic peptide
WVRQAPGKGLEWVS

SEQ ID NO: 14599 - protein, 14 aa, Artificial Sequence
  Description of Artificial Sequence: Synthetic peptide
WVRQAPGKGLEWVS

SEQ ID NO: 14600 - protein, 14 aa, Artificial Sequence
  Description of Artificial Sequence: Synthetic peptide
WVRQAPGKGLEWVS

SEQ ID NO: 14601 - protein, 14 aa, Artificial Sequence
  Description of Artificial Sequence: Synthetic peptide
WVRQAPGKGLEWVS

SEQ ID NO: 14602 - protein, 14 aa, Artificial Sequence
  Description of Artificial Sequence: Synthetic peptide
WVRQAPGKGLEWVS

SEQ ID NO: 14603 - protein, 14 aa, Artificial Sequence
  Description of Artificial Sequence: Synthetic peptide
WVRQAPGKGLEWVS

SEQ ID NO: 14604 - protein, 14 aa, Artificial Sequence
  Description of Artificial Sequence: Synthetic peptide
WVRQAPGKGLEWVS

SEQ ID NO: 14605 - protein, 14 aa, Artificial Sequence
  Description of Artificial Sequence: Synthetic peptide
WVRQAPGKGLEWVS

SEQ ID NO: 14606 - protein, 14 aa, Artificial Sequence
  Description of Artificial Sequence: Synthetic peptide
WVRQAPGKGLEWVS

SEQ ID NO: 14607 - protein, 14 aa, Artificial Sequence
  Description of Artificial Sequence: Synthetic peptide
WVRQAPGKGLEWVS

SEQ ID NO: 14608 - protein, 14 aa, Artificial Sequence
  Description of Artificial Sequence: Synthetic peptide
WVRQAPGQGLEWVS

SEQ ID NO: 14609 - protein, 14 aa, Artificial Sequence
  Description of Artificial Sequence: Synthetic peptide
WVRQAPGKGLEWVS

SEQ ID NO: 14610 - protein, 14 aa, Artificial Sequence
  Description of Artificial Sequence: Synthetic peptide
WVRQAPGKGLEWVS

SEQ ID NO: 14611 - protein, 14 aa, Artificial Sequence
  Description of Artificial Sequence: Synthetic peptide
WVRQAPGKGLEWVS

SEQ ID NO: 14612 - protein, 14 aa, Artificial Sequence
  Description of Artificial Sequence: Synthetic peptide
WVRQAPGKGLEWVS

SEQ ID NO: 14613 - protein, 14 aa, Artificial Sequence
  Description of Artificial Sequence: Synthetic peptide
WVRQAPGKGLEWVS

SEQ ID NO: 14614 - protein, 14 aa, Artificial Sequence
  Description of Artificial Sequence: Synthetic peptide
WVRQAPGKGLEWVS

SEQ ID NO: 14615 - protein, 14 aa, Artificial Sequence
  Description of Artificial Sequence: Synthetic peptide
WVRQAPGKGLEWVS

SEQ ID NO: 14616 - protein, 14 aa, Artificial Sequence
  Description of Artificial Sequence: Synthetic peptide
WVRQAPGKGLEWVS

SEQ ID NO: 14617 - protein, 14 aa, Artificial Sequence
  Description of Artificial Sequence: Synthetic peptide
WVRQAPGKGLEWVS

SEQ ID NO: 14618 - protein, 14 aa, Artificial Sequence
  Description of Artificial Sequence: Synthetic peptide
WVRQAPGKGLEWVS

SEQ ID NO: 14619 - protein, 14 aa, Artificial Sequence
  Description of Artificial Sequence: Synthetic peptide
WVRQAPGKGLEWVS

SEQ ID NO: 14620 - protein, 14 aa, Artificial Sequence
  Description of Artificial Sequence: Synthetic peptide
WVRQAPGKGLEWVS

SEQ ID NO: 14621 - protein, 14 aa, Artificial Sequence
  Description of Artificial Sequence: Synthetic peptide
WVRQAPGQGLEWVS

SEQ ID NO: 14622 - protein, 14 aa, Artificial Sequence
  Description of Artificial Sequence: Synthetic peptide
WVRQAPGKGLEWVS

SEQ ID NO: 14623 - protein, 14 aa, Artificial Sequence
  Description of Artificial Sequence: Synthetic peptide
WVRQAPGKGLEWVS

SEQ ID NO: 14624 - protein, 14 aa, Artificial Sequence
  Description of Artificial Sequence: Synthetic peptide
WVRQAPGQGLEWVS

SEQ ID NO: 14625 - protein, 14 aa, Artificial Sequence
  Description of Artificial Sequence: Synthetic peptide
WVRQAPGKGLEWVS

SEQ ID NO: 14626 - protein, 14 aa, Artificial Sequence
  Description of Artificial Sequence: Synthetic peptide
WVRQAPGKGLEWVS

SEQ ID NO: 14627 - protein, 14 aa, Artificial Sequence
  Description of Artificial Sequence: Synthetic peptide
WVRQAPGKGLEWVS

SEQ ID NO: 14628 - protein, 14 aa, Artificial Sequence
  Description of Artificial Sequence: Synthetic peptide
WVRQAPGKGLEWVS

SEQ ID NO: 14629 - protein, 14 aa, Artificial Sequence
  Description of Artificial Sequence: Synthetic peptide
WVRQAPGKGLEWVS

SEQ ID NO: 14630 - protein, 14 aa, Artificial Sequence
  Description of Artificial Sequence: Synthetic peptide
WVRQAPGKGLEWVS

SEQ ID NO: 14631 - protein, 14 aa, Artificial Sequence
  Description of Artificial Sequence: Synthetic peptide
WVRQAPGKGLEWVS

SEQ ID NO: 14632 - protein, 14 aa, Artificial Sequence
  Description of Artificial Sequence: Synthetic peptide
WVRQAPGKGLEWVS

SEQ ID NO: 14633 - protein, 14 aa, Artificial Sequence
  Description of Artificial Sequence: Synthetic peptide
WVRQAPGKGLEWVS

SEQ ID NO: 14634 - protein, 14 aa, Artificial Sequence
  Description of Artificial Sequence: Synthetic peptide
WVRQAPGKGLEWVS

SEQ ID NO: 14635 - protein, 14 aa, Artificial Sequence
  Description of Artificial Sequence: Synthetic peptide
WVRQAPGKGLEWVS

SEQ ID NO: 14636 - protein, 14 aa, Artificial Sequence
  Description of Artificial Sequence: Synthetic peptide
WVRQAPGKGLEWVS

SEQ ID NO: 14637 - protein, 14 aa, Artificial Sequence
  Description of Artificial Sequence: Synthetic peptide
WVRQAPGKGLEWVS

SEQ ID NO: 14638 - protein, 14 aa, Artificial Sequence
  Description of Artificial Sequence: Synthetic peptide
WVRQAPGKGLEWVS

SEQ ID NO: 14639 - protein, 14 aa, Artificial Sequence
  Description of Artificial Sequence: Synthetic peptide
WVRQAPGQGLEWVS

SEQ ID NO: 14640 - protein, 14 aa, Artificial Sequence
  Description of Artificial Sequence: Synthetic peptide
WVRQAPGKGLEWVA

SEQ ID NO: 14641 - protein, 14 aa, Artificial Sequence
  Description of Artificial Sequence: Synthetic peptide
WVRQAPGKGLEWVA

SEQ ID NO: 14642 - protein, 14 aa, Artificial Sequence
  Description of Artificial Sequence: Synthetic peptide
WVRQAPGKGLEWVA

SEQ ID NO: 14643 - protein, 14 aa, Artificial Sequence
  Description of Artificial Sequence: Synthetic peptide
WVRQAPGKGLEWVA

SEQ ID NO: 14644 - protein, 14 aa, Artificial Sequence
  Description of Artificial Sequence: Synthetic peptide
WVRQAPGQGLEWMG

SEQ ID NO: 14645 - protein, 14 aa, Artificial Sequence
  Description of Artificial Sequence: Synthetic peptide
WVRQAPGQGLEWMG

SEQ ID NO: 14646 - protein, 14 aa, Artificial Sequence
  Description of Artificial Sequence: Synthetic peptide
WVRQAPGQGLEWMG

SEQ ID NO: 14647 - protein, 14 aa, Artificial Sequence
  Description of Artificial Sequence: Synthetic peptide
WIRQAPGKGLEWVS

SEQ ID NO: 14648 - protein, 14 aa, Artificial Sequence
  Description of Artificial Sequence: Synthetic peptide
WIRQAPGKGLEWVS

SEQ ID NO: 14649 - protein, 14 aa, Artificial Sequence
  Description of Artificial Sequence: Synthetic peptide
WIRQAPGKGLEWVS

SEQ ID NO: 14650 - protein, 7 aa, Artificial Sequence
  Description of Artificial Sequence: Synthetic peptide
WASTRES

SEQ ID NO: 14651 - protein, 7 aa, Artificial Sequence
  Description of Artificial Sequence: Synthetic peptide
WASTRES

SEQ ID NO: 14652 - protein, 7 aa, Artificial Sequence
  Description of Artificial Sequence: Synthetic peptide
WASTRES

SEQ ID NO: 14653 - protein, 7 aa, Artificial Sequence
  Description of Artificial Sequence: Synthetic peptide
WASTRES

SEQ ID NO: 14654 - protein, 7 aa, Artificial Sequence
  Description of Artificial Sequence: Synthetic peptide
YASQSFS

SEQ ID NO: 14655 - protein, 7 aa, Artificial Sequence
  Description of Artificial Sequence: Synthetic peptide
DTSKLAP

SEQ ID NO: 14656 - protein, 7 aa, Artificial Sequence
  Description of Artificial Sequence: Synthetic peptide
AASSLQS

SEQ ID NO: 14657 - protein, 7 aa, Artificial Sequence
  Description of Artificial Sequence: Synthetic peptide
NAKTLAG

SEQ ID NO: 14658 - protein, 7 aa, Artificial Sequence
  Description of Artificial Sequence: Synthetic peptide
LGSNRAS

SEQ ID NO: 14659 - protein, 7 aa, Artificial Sequence
  Description of Artificial Sequence: Synthetic peptide
LGSNRAS

SEQ ID NO: 14660 - protein, 7 aa, Artificial Sequence
  Description of Artificial Sequence: Synthetic peptide
LGSNRAS

SEQ ID NO: 14661 - protein, 7 aa, Artificial Sequence
  Description of Artificial Sequence: Synthetic peptide
LGSNRAS

SEQ ID NO: 14662 - protein, 7 aa, Artificial Sequence
  Description of Artificial Sequence: Synthetic peptide
LGSIRAS

SEQ ID NO: 14663 - protein, 7 aa, Artificial Sequence
  Description of Artificial Sequence: Synthetic peptide
LGSNRAS

SEQ ID NO: 14664 - protein, 7 aa, Artificial Sequence
  Description of Artificial Sequence: Synthetic peptide
LGSNRAS

SEQ ID NO: 14665 - protein, 7 aa, Artificial Sequence
  Description of Artificial Sequence: Synthetic peptide
LGSKRAS

SEQ ID NO: 14666 - protein, 7 aa, Artificial Sequence
  Description of Artificial Sequence: Synthetic peptide
LGSNRAS

SEQ ID NO: 14667 - protein, 7 aa, Artificial Sequence
  Description of Artificial Sequence: Synthetic peptide
LGSNRAS

SEQ ID NO: 14668 - protein, 7 aa, Artificial Sequence
  Description of Artificial Sequence: Synthetic peptide
LGSNRAS

SEQ ID NO: 14669 - protein, 7 aa, Artificial Sequence
  Description of Artificial Sequence: Synthetic peptide
LGSNRAS

SEQ ID NO: 14670 - protein, 7 aa, Artificial Sequence
  Description of Artificial Sequence: Synthetic peptide
TLSYRAS

SEQ ID NO: 14671 - protein, 7 aa, Artificial Sequence
  Description of Artificial Sequence: Synthetic peptide
LGSKRAS

SEQ ID NO: 14672 - protein, 7 aa, Artificial Sequence
  Description of Artificial Sequence: Synthetic peptide
LGSNRAS

SEQ ID NO: 14673 - protein, 7 aa, Artificial Sequence
  Description of Artificial Sequence: Synthetic peptide
LGSNRAS

SEQ ID NO: 14674 - protein, 7 aa, Artificial Sequence
  Description of Artificial Sequence: Synthetic peptide
LGSNRAS

SEQ ID NO: 14675 - protein, 7 aa, Artificial Sequence
  Description of Artificial Sequence: Synthetic peptide
LGSNRAS

SEQ ID NO: 14676 - protein, 7 aa, Artificial Sequence
  Description of Artificial Sequence: Synthetic peptide
LGSNRAS

SEQ ID NO: 14677 - protein, 7 aa, Artificial Sequence
  Description of Artificial Sequence: Synthetic peptide
LGSNRAS

SEQ ID NO: 14678 - protein, 7 aa, Artificial Sequence
  Description of Artificial Sequence: Synthetic peptide
GASSRAT

SEQ ID NO: 14679 - protein, 7 aa, Artificial Sequence
  Description of Artificial Sequence: Synthetic peptide
GASSRAT

SEQ ID NO: 14680 - protein, 7 aa, Artificial Sequence
  Description of Artificial Sequence: Synthetic peptide
GASSRAT

SEQ ID NO: 14681 - protein, 7 aa, Artificial Sequence
  Description of Artificial Sequence: Synthetic peptide
GASSRAT

SEQ ID NO: 14682 - protein, 7 aa, Artificial Sequence
  Description of Artificial Sequence: Synthetic peptide
GASSRAT

SEQ ID NO: 14683 - protein, 7 aa, Artificial Sequence
  Description of Artificial Sequence: Synthetic peptide
GASSRAT

SEQ ID NO: 14684 - protein, 7 aa, Artificial Sequence
  Description of Artificial Sequence: Synthetic peptide
GASARAT

SEQ ID NO: 14685 - protein, 7 aa, Artificial Sequence
  Description of Artificial Sequence: Synthetic peptide
GASSRAT

SEQ ID NO: 14686 - protein, 7 aa, Artificial Sequence
  Description of Artificial Sequence: Synthetic peptide
GASTRAT

SEQ ID NO: 14687 - protein, 7 aa, Artificial Sequence
  Description of Artificial Sequence: Synthetic peptide
LGSNRAS

SEQ ID NO: 14688 - protein, 7 aa, Artificial Sequence
  Description of Artificial Sequence: Synthetic peptide
LGSNRAS

SEQ ID NO: 14689 - protein, 7 aa, Artificial Sequence
  Description of Artificial Sequence: Synthetic peptide
LGSNRAS

SEQ ID NO: 14690 - protein, 7 aa, Artificial Sequence
  Description of Artificial Sequence: Synthetic peptide
LGSNRAS

SEQ ID NO: 14691 - protein, 7 aa, Artificial Sequence
  Description of Artificial Sequence: Synthetic peptide
LGSNRAS

SEQ ID NO: 14692 - protein, 7 aa, Artificial Sequence
  Description of Artificial Sequence: Synthetic peptide
LGSNRAS

SEQ ID NO: 14693 - protein, 7 aa, Artificial Sequence
  Description of Artificial Sequence: Synthetic peptide
LGSNRAS

SEQ ID NO: 14694 - protein, 7 aa, Artificial Sequence
  Description of Artificial Sequence: Synthetic peptide
LGSNRAS

SEQ ID NO: 14695 - protein, 7 aa, Artificial Sequence
  Description of Artificial Sequence: Synthetic peptide
LGSNRAS

SEQ ID NO: 14696 - protein, 7 aa, Artificial Sequence
  Description of Artificial Sequence: Synthetic peptide
LGSNRAS

SEQ ID NO: 14697 - protein, 7 aa, Artificial Sequence
  Description of Artificial Sequence: Synthetic peptide
LGSNRAS

SEQ ID NO: 14698 - protein, 7 aa, Artificial Sequence
  Description of Artificial Sequence: Synthetic peptide
LGSNRAS

SEQ ID NO: 14699 - protein, 7 aa, Artificial Sequence
  Description of Artificial Sequence: Synthetic peptide
AASSLQS

SEQ ID NO: 14700 - protein, 7 aa, Artificial Sequence
  Description of Artificial Sequence: Synthetic peptide
AASSLQS

SEQ ID NO: 14701 - protein, 7 aa, Artificial Sequence
  Description of Artificial Sequence: Synthetic peptide
AASSLQS

SEQ ID NO: 14702 - protein, 7 aa, Artificial Sequence
  Description of Artificial Sequence: Synthetic peptide
LGSNRAS

SEQ ID NO: 14703 - protein, 7 aa, Artificial Sequence
  Description of Artificial Sequence: Synthetic peptide
LGSNRAS

SEQ ID NO: 14704 - protein, 7 aa, Artificial Sequence
  Description of Artificial Sequence: Synthetic peptide
LGSNRAS

SEQ ID NO: 14705 - protein, 7 aa, Artificial Sequence
  Description of Artificial Sequence: Synthetic peptide
LGSYRAS

SEQ ID NO: 14706 - protein, 7 aa, Artificial Sequence
  Description of Artificial Sequence: Synthetic peptide
LGSNRAS

SEQ ID NO: 14707 - protein, 7 aa, Artificial Sequence
  Description of Artificial Sequence: Synthetic peptide
LGSNRAS

SEQ ID NO: 14708 - protein, 7 aa, Artificial Sequence
  Description of Artificial Sequence: Synthetic peptide
TLSYRAS

SEQ ID NO: 14709 - protein, 7 aa, Artificial Sequence
  Description of Artificial Sequence: Synthetic peptide
LGSNRAS

SEQ ID NO: 14710 - protein, 7 aa, Artificial Sequence
  Description of Artificial Sequence: Synthetic peptide
LGSNRAS

SEQ ID NO: 14711 - protein, 7 aa, Artificial Sequence
  Description of Artificial Sequence: Synthetic peptide
AASSLQS

SEQ ID NO: 14712 - protein, 7 aa, Artificial Sequence
  Description of Artificial Sequence: Synthetic peptide
DASSLQS

SEQ ID NO: 14713 - protein, 7 aa, Artificial Sequence
  Description of Artificial Sequence: Synthetic peptide
ATSSLQS

SEQ ID NO: 14714 - protein, 7 aa, Artificial Sequence
  Description of Artificial Sequence: Synthetic peptide
AASSLQS

SEQ ID NO: 14715 - protein, 7 aa, Artificial Sequence
  Description of Artificial Sequence: Synthetic peptide
AASSLQS

SEQ ID NO: 14716 - protein, 7 aa, Artificial Sequence
  Description of Artificial Sequence: Synthetic peptide
AASSLQS

SEQ ID NO: 14717 - protein, 7 aa, Artificial Sequence
  Description of Artificial Sequence: Synthetic peptide
AASSLQS

SEQ ID NO: 14718 - protein, 7 aa, Artificial Sequence
  Description of Artificial Sequence: Synthetic peptide
AASSLQS

SEQ ID NO: 14719 - protein, 7 aa, Artificial Sequence
  Description of Artificial Sequence: Synthetic peptide
TLSYRAS

SEQ ID NO: 14720 - protein, 7 aa, Artificial Sequence
  Description of Artificial Sequence: Synthetic peptide
LGSNRAS

SEQ ID NO: 14721 - protein, 7 aa, Artificial Sequence
  Description of Artificial Sequence: Synthetic peptide
LGSNRAS

SEQ ID NO: 14722 - protein, 7 aa, Artificial Sequence
  Description of Artificial Sequence: Synthetic peptide
LGSNRAS

SEQ ID NO: 14723 - protein, 7 aa, Artificial Sequence
  Description of Artificial Sequence: Synthetic peptide
LGSNRAS

SEQ ID NO: 14724 - protein, 7 aa, Artificial Sequence
  Description of Artificial Sequence: Synthetic peptide
LGSNRAS

SEQ ID NO: 14725 - protein, 7 aa, Artificial Sequence
  Description of Artificial Sequence: Synthetic peptide
LGSNRAS

SEQ ID NO: 14726 - protein, 7 aa, Artificial Sequence
  Description of Artificial Sequence: Synthetic peptide
LGSNRAS

SEQ ID NO: 14727 - protein, 7 aa, Artificial Sequence
  Description of Artificial Sequence: Synthetic peptide
LGSNRAS

SEQ ID NO: 14728 - protein, 7 aa, Artificial Sequence
  Description of Artificial Sequence: Synthetic peptide
LGSNRAS

SEQ ID NO: 14729 - protein, 7 aa, Artificial Sequence
  Description of Artificial Sequence: Synthetic peptide
LGSNRAS

SEQ ID NO: 14730 - protein, 7 aa, Artificial Sequence
  Description of Artificial Sequence: Synthetic peptide
LGSNRAS

SEQ ID NO: 14731 - protein, 7 aa, Artificial Sequence
  Description of Artificial Sequence: Synthetic peptide
LGSNRAS

SEQ ID NO: 14732 - protein, 7 aa, Artificial Sequence
  Description of Artificial Sequence: Synthetic peptide
TLSYRAS

SEQ ID NO: 14733 - protein, 7 aa, Artificial Sequence
  Description of Artificial Sequence: Synthetic peptide
LVSKRAS

SEQ ID NO: 14734 - protein, 7 aa, Artificial Sequence
  Description of Artificial Sequence: Synthetic peptide
LGSNRAS

SEQ ID NO: 14735 - protein, 7 aa, Artificial Sequence
  Description of Artificial Sequence: Synthetic peptide
LGSKRAS

SEQ ID NO: 14736 - protein, 7 aa, Artificial Sequence
  Description of Artificial Sequence: Synthetic peptide
AASTLQS

SEQ ID NO: 14737 - protein, 7 aa, Artificial Sequence
  Description of Artificial Sequence: Synthetic peptide
AASSLQS

SEQ ID NO: 14738 - protein, 7 aa, Artificial Sequence
  Description of Artificial Sequence: Synthetic peptide
GASTLQL

SEQ ID NO: 14739 - protein, 7 aa, Artificial Sequence
  Description of Artificial Sequence: Synthetic peptide
AASTLQS

SEQ ID NO: 14740 - protein, 7 aa, Artificial Sequence
  Description of Artificial Sequence: Synthetic peptide
AASTLQS

SEQ ID NO: 14741 - protein, 7 aa, Artificial Sequence
  Description of Artificial Sequence: Synthetic peptide
AASTLQS

SEQ ID NO: 14742 - protein, 7 aa, Artificial Sequence
  Description of Artificial Sequence: Synthetic peptide
AASTLQS

SEQ ID NO: 14743 - protein, 7 aa, Artificial Sequence
  Description of Artificial Sequence: Synthetic peptide
TLSYRAS

SEQ ID NO: 14744 - protein, 7 aa, Artificial Sequence
  Description of Artificial Sequence: Synthetic peptide
LGSNRAS

SEQ ID NO: 14745 - protein, 7 aa, Artificial Sequence
  Description of Artificial Sequence: Synthetic peptide
AASTLQS

SEQ ID NO: 14746 - protein, 7 aa, Artificial Sequence
  Description of Artificial Sequence: Synthetic peptide
AASTLQS

SEQ ID NO: 14747 - protein, 7 aa, Artificial Sequence
  Description of Artificial Sequence: Synthetic peptide
EVSSRFS

SEQ ID NO: 14748 - protein, 7 aa, Artificial Sequence
  Description of Artificial Sequence: Synthetic peptide
LGSNRAS

SEQ ID NO: 14749 - protein, 7 aa, Artificial Sequence
  Description of Artificial Sequence: Synthetic peptide
WASTRES

SEQ ID NO: 14750 - protein, 7 aa, Artificial Sequence
  Description of Artificial Sequence: Synthetic peptide
WASTRES

SEQ ID NO: 14751 - protein, 7 aa, Artificial Sequence
  Description of Artificial Sequence: Synthetic peptide
WASTRES

SEQ ID NO: 14752 - protein, 7 aa, Artificial Sequence
  Description of Artificial Sequence: Synthetic peptide
WASTRES

SEQ ID NO: 14753 - protein, 7 aa, Artificial Sequence
  Description of Artificial Sequence: Synthetic peptide
DASNLET

SEQ ID NO: 14754 - protein, 7 aa, Artificial Sequence
  Description of Artificial Sequence: Synthetic peptide
DASNLET

SEQ ID NO: 14755 - protein, 7 aa, Artificial Sequence
  Description of Artificial Sequence: Synthetic peptide
WASTRES

SEQ ID NO: 14756 - protein, 7 aa, Artificial Sequence
  Description of Artificial Sequence: Synthetic peptide
WASTRES

SEQ ID NO: 14757 - protein, 7 aa, Artificial Sequence
  Description of Artificial Sequence: Synthetic peptide
WASTRES

SEQ ID NO: 14758 - protein, 7 aa, Artificial Sequence
  Description of Artificial Sequence: Synthetic peptide
WASTRES

SEQ ID NO: 14759 - protein, 7 aa, Artificial Sequence
  Description of Artificial Sequence: Synthetic peptide
WASTRES

SEQ ID NO: 14760 - protein, 7 aa, Artificial Sequence
  Description of Artificial Sequence: Synthetic peptide
AASSLQS

SEQ ID NO: 14761 - protein, 7 aa, Artificial Sequence
  Description of Artificial Sequence: Synthetic peptide
AASSLQS

SEQ ID NO: 14762 - protein, 7 aa, Artificial Sequence
  Description of Artificial Sequence: Synthetic peptide
AASSLQS

SEQ ID NO: 14763 - protein, 7 aa, Artificial Sequence
  Description of Artificial Sequence: Synthetic peptide
AASSLQG

SEQ ID NO: 14764 - protein, 7 aa, Artificial Sequence
  Description of Artificial Sequence: Synthetic peptide
AASSLQS

SEQ ID NO: 14765 - protein, 7 aa, Artificial Sequence
  Description of Artificial Sequence: Synthetic peptide
AASSLQS

SEQ ID NO: 14766 - protein, 7 aa, Artificial Sequence
  Description of Artificial Sequence: Synthetic peptide
AASSLQG

SEQ ID NO: 14767 - protein, 7 aa, Artificial Sequence
  Description of Artificial Sequence: Synthetic peptide
AASSLQG

SEQ ID NO: 14768 - protein, 7 aa, Artificial Sequence
  Description of Artificial Sequence: Synthetic peptide
AASSLQG

SEQ ID NO: 14769 - protein, 7 aa, Artificial Sequence
  Description of Artificial Sequence: Synthetic peptide
AASSLQG

SEQ ID NO: 14770 - protein, 7 aa, Artificial Sequence
  Description of Artificial Sequence: Synthetic peptide
AASSLQS

SEQ ID NO: 14771 - protein, 7 aa, Artificial Sequence
  Description of Artificial Sequence: Synthetic peptide
AASSLQS

SEQ ID NO: 14772 - protein, 7 aa, Artificial Sequence
  Description of Artificial Sequence: Synthetic peptide
AASSLQS

SEQ ID NO: 14773 - protein, 7 aa, Artificial Sequence
  Description of Artificial Sequence: Synthetic peptide
AASSLQS

SEQ ID NO: 14774 - protein, 7 aa, Artificial Sequence
  Description of Artificial Sequence: Synthetic peptide
AASSLQG

SEQ ID NO: 14775 - protein, 7 aa, Artificial Sequence
  Description of Artificial Sequence: Synthetic peptide
AASSLQS

SEQ ID NO: 14776 - protein, 7 aa, Artificial Sequence
  Description of Artificial Sequence: Synthetic peptide
ATSSLQS

SEQ ID NO: 14777 - protein, 7 aa, Artificial Sequence
  Description of Artificial Sequence: Synthetic peptide
AASSLQG

SEQ ID NO: 14778 - protein, 7 aa, Artificial Sequence
  Description of Artificial Sequence: Synthetic peptide
AASSLQS

SEQ ID NO: 14779 - protein, 7 aa, Artificial Sequence
  Description of Artificial Sequence: Synthetic peptide
AASSLQG

SEQ ID NO: 14780 - protein, 7 aa, Artificial Sequence
  Description of Artificial Sequence: Synthetic peptide
AASSLQS

SEQ ID NO: 14781 - protein, 7 aa, Artificial Sequence
  Description of Artificial Sequence: Synthetic peptide
AASSLQG

SEQ ID NO: 14782 - protein, 7 aa, Artificial Sequence
  Description of Artificial Sequence: Synthetic peptide
AASSLQS

SEQ ID NO: 14783 - protein, 7 aa, Artificial Sequence
  Description of Artificial Sequence: Synthetic peptide
AASSLQS

SEQ ID NO: 14784 - protein, 7 aa, Artificial Sequence
  Description of Artificial Sequence: Synthetic peptide
AASSLQS

SEQ ID NO: 14785 - protein, 7 aa, Artificial Sequence
  Description of Artificial Sequence: Synthetic peptide
AASSLQG

SEQ ID NO: 14786 - protein, 7 aa, Artificial Sequence
  Description of Artificial Sequence: Synthetic peptide
AASSLQS

SEQ ID NO: 14787 - protein, 7 aa, Artificial Sequence
  Description of Artificial Sequence: Synthetic peptide
AASSLQS

SEQ ID NO: 14788 - protein, 7 aa, Artificial Sequence
  Description of Artificial Sequence: Synthetic peptide
AASSLQG

SEQ ID NO: 14789 - protein, 7 aa, Artificial Sequence
  Description of Artificial Sequence: Synthetic peptide
AASSLQG

SEQ ID NO: 14790 - protein, 7 aa, Artificial Sequence
  Description of Artificial Sequence: Synthetic peptide
AASSLQG

SEQ ID NO: 14791 - protein, 7 aa, Artificial Sequence
  Description of Artificial Sequence: Synthetic peptide
AASSLQG

SEQ ID NO: 14792 - protein, 7 aa, Artificial Sequence
  Description of Artificial Sequence: Synthetic peptide
AASSLQG

SEQ ID NO: 14793 - protein, 7 aa, Artificial Sequence
  Description of Artificial Sequence: Synthetic peptide
AASSLQS

SEQ ID NO: 14794 - protein, 7 aa, Artificial Sequence
  Description of Artificial Sequence: Synthetic peptide
AASSLQG

SEQ ID NO: 14795 - protein, 7 aa, Artificial Sequence
  Description of Artificial Sequence: Synthetic peptide
AASSLQG

SEQ ID NO: 14796 - protein, 7 aa, Artificial Sequence
  Description of Artificial Sequence: Synthetic peptide
AASSLQS

SEQ ID NO: 14797 - protein, 7 aa, Artificial Sequence
  Description of Artificial Sequence: Synthetic peptide
AASSLQS

SEQ ID NO: 14798 - protein, 7 aa, Artificial Sequence
  Description of Artificial Sequence: Synthetic peptide
AASSLQS

SEQ ID NO: 14799 - protein, 7 aa, Artificial Sequence
  Description of Artificial Sequence: Synthetic peptide
GASSRAT

SEQ ID NO: 14800 - protein, 7 aa, Artificial Sequence
  Description of Artificial Sequence: Synthetic peptide
LGSNRAS

SEQ ID NO: 14801 - protein, 7 aa, Artificial Sequence
  Description of Artificial Sequence: Synthetic peptide
AASTLQS

SEQ ID NO: 14802 - protein, 7 aa, Artificial Sequence
  Description of Artificial Sequence: Synthetic peptide
AASTLQS

SEQ ID NO: 14803 - protein, 7 aa, Artificial Sequence
  Description of Artificial Sequence: Synthetic peptide
WASTRES

SEQ ID NO: 14804 - protein, 7 aa, Artificial Sequence
  Description of Artificial Sequence: Synthetic peptide
WASTRES

SEQ ID NO: 14805 - protein, 7 aa, Artificial Sequence
  Description of Artificial Sequence: Synthetic peptide
WASTRES

SEQ ID NO: 14806 - protein, 7 aa, Artificial Sequence
  Description of Artificial Sequence: Synthetic peptide
AASSLQS

SEQ ID NO: 14807 - protein, 7 aa, Artificial Sequence
  Description of Artificial Sequence: Synthetic peptide
AASSLQS

SEQ ID NO: 14808 - protein, 7 aa, Artificial Sequence
  Description of Artificial Sequence: Synthetic peptide
EVSNRPS

SEQ ID NO: 14809 - protein, 7 aa, Artificial Sequence
  Description of Artificial Sequence: Synthetic peptide
EVSKRPS

SEQ ID NO: 14810 - protein, 7 aa, Artificial Sequence
  Description of Artificial Sequence: Synthetic peptide
RNNQRPS

SEQ ID NO: 14811 - protein, 7 aa, Artificial Sequence
  Description of Artificial Sequence: Synthetic peptide
RNNQRPS

SEQ ID NO: 14812 - protein, 7 aa, Artificial Sequence
  Description of Artificial Sequence: Synthetic peptide
RNNNRPS

SEQ ID NO: 14813 - protein, 7 aa, Artificial Sequence
  Description of Artificial Sequence: Synthetic peptide
RNNNRPS

SEQ ID NO: 14814 - protein, 7 aa, Artificial Sequence
  Description of Artificial Sequence: Synthetic peptide
RNNNRPS

SEQ ID NO: 14815 - protein, 7 aa, Artificial Sequence
  Description of Artificial Sequence: Synthetic peptide
EVSKRPS

SEQ ID NO: 14816 - protein, 7 aa, Artificial Sequence
  Description of Artificial Sequence: Synthetic peptide
EVSKRPS

SEQ ID NO: 14817 - protein, 7 aa, Artificial Sequence
  Description of Artificial Sequence: Synthetic peptide
RNNNRPS

SEQ ID NO: 14818 - protein, 7 aa, Artificial Sequence
  Description of Artificial Sequence: Synthetic peptide
RNNNRPS

SEQ ID NO: 14819 - protein, 7 aa, Artificial Sequence
  Description of Artificial Sequence: Synthetic peptide
YDSDRPS

SEQ ID NO: 14820 - protein, 7 aa, Artificial Sequence
  Description of Artificial Sequence: Synthetic peptide
DDNDRPS

SEQ ID NO: 14821 - protein, 7 aa, Artificial Sequence
  Description of Artificial Sequence: Synthetic peptide
DDNDRPS

SEQ ID NO: 14822 - protein, 7 aa, Artificial Sequence
  Description of Artificial Sequence: Synthetic peptide
DDNDRPS

SEQ ID NO: 14823 - protein, 7 aa, Artificial Sequence
  Description of Artificial Sequence: Synthetic peptide
DDNDRPS

SEQ ID NO: 14824 - protein, 7 aa, Artificial Sequence
  Description of Artificial Sequence: Synthetic peptide
DDNDRPS

SEQ ID NO: 14825 - protein, 7 aa, Artificial Sequence
  Description of Artificial Sequence: Synthetic peptide
DDNDRPS

SEQ ID NO: 14826 - protein, 7 aa, Artificial Sequence
  Description of Artificial Sequence: Synthetic peptide
DDNDRPS

SEQ ID NO: 14827 - protein, 7 aa, Artificial Sequence
  Description of Artificial Sequence: Synthetic peptide
DDNDRPS

SEQ ID NO: 14828 - protein, 7 aa, Artificial Sequence
  Description of Artificial Sequence: Synthetic peptide
DDNDRPS

SEQ ID NO: 14829 - protein, 7 aa, Artificial Sequence
  Description of Artificial Sequence: Synthetic peptide
DDNDRPS

SEQ ID NO: 14830 - protein, 7 aa, Artificial Sequence
  Description of Artificial Sequence: Synthetic peptide
DDNDRPS

SEQ ID NO: 14831 - protein, 7 aa, Artificial Sequence
  Description of Artificial Sequence: Synthetic peptide
DDNDRPS

SEQ ID NO: 14832 - protein, 7 aa, Artificial Sequence
  Description of Artificial Sequence: Synthetic peptide
DDNDRPS

SEQ ID NO: 14833 - protein, 7 aa, Artificial Sequence
  Description of Artificial Sequence: Synthetic peptide
DDNDRPS

SEQ ID NO: 14834 - protein, 7 aa, Artificial Sequence
  Description of Artificial Sequence: Synthetic peptide
DDNDRPS

SEQ ID NO: 14835 - protein, 7 aa, Artificial Sequence
  Description of Artificial Sequence: Synthetic peptide
DDNDRPS

SEQ ID NO: 14836 - protein, 7 aa, Artificial Sequence
  Description of Artificial Sequence: Synthetic peptide
DDNDRPS

SEQ ID NO: 14837 - protein, 7 aa, Artificial Sequence
  Description of Artificial Sequence: Synthetic peptide
DDNDRPS

SEQ ID NO: 14838 - protein, 7 aa, Artificial Sequence
  Description of Artificial Sequence: Synthetic peptide
DDNDRPS

SEQ ID NO: 14839 - protein, 7 aa, Artificial Sequence
  Description of Artificial Sequence: Synthetic peptide
DDNDRPS

SEQ ID NO: 14840 - protein, 7 aa, Artificial Sequence
  Description of Artificial Sequence: Synthetic peptide
DDNDRPS

SEQ ID NO: 14841 - protein, 7 aa, Artificial Sequence
  Description of Artificial Sequence: Synthetic peptide
DDNDRPS

SEQ ID NO: 14842 - protein, 7 aa, Artificial Sequence
  Description of Artificial Sequence: Synthetic peptide
DDNDRPS

SEQ ID NO: 14843 - protein, 7 aa, Artificial Sequence
  Description of Artificial Sequence: Synthetic peptide
DDNDRPS

SEQ ID NO: 14844 - protein, 7 aa, Artificial Sequence
  Description of Artificial Sequence: Synthetic peptide
DDNDRPS

SEQ ID NO: 14845 - protein, 7 aa, Artificial Sequence
  Description of Artificial Sequence: Synthetic peptide
DDNDRPS

SEQ ID NO: 14846 - protein, 7 aa, Artificial Sequence
  Description of Artificial Sequence: Synthetic peptide
DDNDRPS

SEQ ID NO: 14847 - protein, 7 aa, Artificial Sequence
  Description of Artificial Sequence: Synthetic peptide
DDNDRPS

SEQ ID NO: 14848 - protein, 7 aa, Artificial Sequence
  Description of Artificial Sequence: Synthetic peptide
DDNDRPS

SEQ ID NO: 14849 - protein, 7 aa, Artificial Sequence
  Description of Artificial Sequence: Synthetic peptide
DDNDRPS

SEQ ID NO: 14850 - protein, 7 aa, Artificial Sequence
  Description of Artificial Sequence: Synthetic peptide
DDNDRPS

SEQ ID NO: 14851 - protein, 7 aa, Artificial Sequence
  Description of Artificial Sequence: Synthetic peptide
DDNDRPS

SEQ ID NO: 14852 - protein, 7 aa, Artificial Sequence
  Description of Artificial Sequence: Synthetic peptide
DDNDRPS

SEQ ID NO: 14853 - protein, 7 aa, Artificial Sequence
  Description of Artificial Sequence: Synthetic peptide
DDNDRPS

SEQ ID NO: 14854 - protein, 7 aa, Artificial Sequence
  Description of Artificial Sequence: Synthetic peptide
DDSDRPS

SEQ ID NO: 14855 - protein, 7 aa, Artificial Sequence
  Description of Artificial Sequence: Synthetic peptide
DDNDRPS

SEQ ID NO: 14856 - protein, 7 aa, Artificial Sequence
  Description of Artificial Sequence: Synthetic peptide
DDNDRPS

SEQ ID NO: 14857 - protein, 7 aa, Artificial Sequence
  Description of Artificial Sequence: Synthetic peptide
DDNDRPS

SEQ ID NO: 14858 - protein, 7 aa, Artificial Sequence
  Description of Artificial Sequence: Synthetic peptide
DDNDRPS

SEQ ID NO: 14859 - protein, 7 aa, Artificial Sequence
  Description of Artificial Sequence: Synthetic peptide
DDNDRPS

SEQ ID NO: 14860 - protein, 7 aa, Artificial Sequence
  Description of Artificial Sequence: Synthetic peptide
DDNDRPS

SEQ ID NO: 14861 - protein, 7 aa, Artificial Sequence
  Description of Artificial Sequence: Synthetic peptide
DDNDRPS

SEQ ID NO: 14862 - protein, 7 aa, Artificial Sequence
  Description of Artificial Sequence: Synthetic peptide
DDNDRPS

SEQ ID NO: 14863 - protein, 7 aa, Artificial Sequence
  Description of Artificial Sequence: Synthetic peptide
DDNDRPS

SEQ ID NO: 14864 - protein, 7 aa, Artificial Sequence
  Description of Artificial Sequence: Synthetic peptide
DDNDRPS

SEQ ID NO: 14865 - protein, 7 aa, Artificial Sequence
  Description of Artificial Sequence: Synthetic peptide
DDNDRPS

SEQ ID NO: 14866 - protein, 7 aa, Artificial Sequence
  Description of Artificial Sequence: Synthetic peptide
DDNDRPS

SEQ ID NO: 14867 - protein, 7 aa, Artificial Sequence
  Description of Artificial Sequence: Synthetic peptide
DDNDRPS

SEQ ID NO: 14868 - protein, 7 aa, Artificial Sequence
  Description of Artificial Sequence: Synthetic peptide
DDNDRPS

SEQ ID NO: 14869 - protein, 7 aa, Artificial Sequence
  Description of Artificial Sequence: Synthetic peptide
DDADRPS

SEQ ID NO: 14870 - protein, 7 aa, Artificial Sequence
  Description of Artificial Sequence: Synthetic peptide
DDNDRPS

SEQ ID NO: 14871 - protein, 7 aa, Artificial Sequence
  Description of Artificial Sequence: Synthetic peptide
DDNDRPS

SEQ ID NO: 14872 - protein, 7 aa, Artificial Sequence
  Description of Artificial Sequence: Synthetic peptide
DDNDRPS

SEQ ID NO: 14873 - protein, 7 aa, Artificial Sequence
  Description of Artificial Sequence: Synthetic peptide
DDNDRPS

SEQ ID NO: 14874 - protein, 7 aa, Artificial Sequence
  Description of Artificial Sequence: Synthetic peptide
DDNDRPS

SEQ ID NO: 14875 - protein, 7 aa, Artificial Sequence
  Description of Artificial Sequence: Synthetic peptide
DDNDRPS

SEQ ID NO: 14876 - protein, 7 aa, Artificial Sequence
  Description of Artificial Sequence: Synthetic peptide
DDNDRPS

SEQ ID NO: 14877 - protein, 7 aa, Artificial Sequence
  Description of Artificial Sequence: Synthetic peptide
DDNDRPS

SEQ ID NO: 14878 - protein, 7 aa, Artificial Sequence
  Description of Artificial Sequence: Synthetic peptide
YDSDRPS

SEQ ID NO: 14879 - protein, 7 aa, Artificial Sequence
  Description of Artificial Sequence: Synthetic peptide
DDNDRPS

SEQ ID NO: 14880 - protein, 7 aa, Artificial Sequence
  Description of Artificial Sequence: Synthetic peptide
DDNDRPS

SEQ ID NO: 14881 - protein, 17 aa, Artificial Sequence
  Description of Artificial Sequence: Synthetic peptide
LVDPEDGETIYAEKFQG

SEQ ID NO: 14882 - protein, 17 aa, Artificial Sequence
  Description of Artificial Sequence: Synthetic peptide
RIYPGDGDTNYNGKFKG

SEQ ID NO: 14883 - protein, 17 aa, Artificial Sequence
  Description of Artificial Sequence: Synthetic peptide
GIIPIFGTANYAQKFQG

SEQ ID NO: 14884 - protein, 17 aa, Artificial Sequence
  Description of Artificial Sequence: Synthetic peptide
RVWPGDGDTTYNEKFKG

SEQ ID NO: 14885 - protein, 17 aa, Artificial Sequence
  Description of Artificial Sequence: Synthetic peptide
GIIPIFGTANYAQKFQG

SEQ ID NO: 14886 - protein, 17 aa, Artificial Sequence
  Description of Artificial Sequence: Synthetic peptide
RIYPGDGDTNYNGKFKD

SEQ ID NO: 14887 - protein, 17 aa, Artificial Sequence
  Description of Artificial Sequence: Synthetic peptide
WMNPNSGNTGYAQKFQG

SEQ ID NO: 14888 - protein, 17 aa, Artificial Sequence
  Description of Artificial Sequence: Synthetic peptide
WMNPNSGNTGYAQKFQG

SEQ ID NO: 14889 - protein, 17 aa, Artificial Sequence
  Description of Artificial Sequence: Synthetic peptide
WMNPNSGNTGYAQKFQG

SEQ ID NO: 14890 - protein, 17 aa, Artificial Sequence
  Description of Artificial Sequence: Synthetic peptide
WMNPNSGNTGYAQKFQG

SEQ ID NO: 14891 - protein, 17 aa, Artificial Sequence
  Description of Artificial Sequence: Synthetic peptide
WMNPNSGNTGYAQKFQG

SEQ ID NO: 14892 - protein, 17 aa, Artificial Sequence
  Description of Artificial Sequence: Synthetic peptide
WMNPNRGTTGYAQKFQG

SEQ ID NO: 14893 - protein, 17 aa, Artificial Sequence
  Description of Artificial Sequence: Synthetic peptide
WMNPNSGNTGYAQKFQG

SEQ ID NO: 14894 - protein, 16 aa, Artificial Sequence
  Description of Artificial Sequence: Synthetic peptide
EINHSGSTNYNPSLKS

SEQ ID NO: 14895 - protein, 16 aa, Artificial Sequence
  Description of Artificial Sequence: Synthetic peptide
EISHSGSTNYNPSLKS

SEQ ID NO: 14896 - protein, 16 aa, Artificial Sequence
  Description of Artificial Sequence: Synthetic peptide
EINHSGRTNYNPSLKS

SEQ ID NO: 14897 - protein, 16 aa, Artificial Sequence
  Description of Artificial Sequence: Synthetic peptide
EINHRGSTNYNPSLKS

SEQ ID NO: 14898 - protein, 16 aa, Artificial Sequence
  Description of Artificial Sequence: Synthetic peptide
EINHSGSTTYNPSLKS

SEQ ID NO: 14899 - protein, 16 aa, Artificial Sequence
  Description of Artificial Sequence: Synthetic peptide
EINHRGSTNYNPSLKS

SEQ ID NO: 14900 - protein, 16 aa, Artificial Sequence
  Description of Artificial Sequence: Synthetic peptide
EISHSGSTNYNPSLKS

SEQ ID NO: 14901 - protein, 16 aa, Artificial Sequence
  Description of Artificial Sequence: Synthetic peptide
EINHSGSTNYNPSLKS

SEQ ID NO: 14902 - protein, 16 aa, Artificial Sequence
  Description of Artificial Sequence: Synthetic peptide
EITHSGSTNYNPSLKS

SEQ ID NO: 14903 - protein, 16 aa, Artificial Sequence
  Description of Artificial Sequence: Synthetic peptide
EINHSGRTNYNPSLKS

SEQ ID NO: 14904 - protein, 16 aa, Artificial Sequence
  Description of Artificial Sequence: Synthetic peptide
EINHRGSTNYNPSLKS

SEQ ID NO: 14905 - protein, 17 aa, Artificial Sequence
  Description of Artificial Sequence: Synthetic peptide
AISGSGGSTYYADSVKG

SEQ ID NO: 14906 - protein, 17 aa, Artificial Sequence
  Description of Artificial Sequence: Synthetic peptide
AISGSGDITYYADSVKG

SEQ ID NO: 14907 - protein, 17 aa, Artificial Sequence
  Description of Artificial Sequence: Synthetic peptide
AISGSGDYTYYADSVKG

SEQ ID NO: 14908 - protein, 17 aa, Artificial Sequence
  Description of Artificial Sequence: Synthetic peptide
AISGSGDITYYADSVKG

SEQ ID NO: 14909 - protein, 17 aa, Artificial Sequence
  Description of Artificial Sequence: Synthetic peptide
AISGSGSSTYYADSVKG

SEQ ID NO: 14910 - protein, 17 aa, Artificial Sequence
  Description of Artificial Sequence: Synthetic peptide
AISGSGDITYYADSVKG

SEQ ID NO: 14911 - protein, 17 aa, Artificial Sequence
  Description of Artificial Sequence: Synthetic peptide
VISYDGSNKYYADSVKG

SEQ ID NO: 14912 - protein, 17 aa, Artificial Sequence
  Description of Artificial Sequence: Synthetic peptide
VISYDGGNKYYADSVKG

SEQ ID NO: 14913 - protein, 17 aa, Artificial Sequence
  Description of Artificial Sequence: Synthetic peptide
VISYDGSNKYYADSVKG

SEQ ID NO: 14914 - protein, 16 aa, Artificial Sequence
  Description of Artificial Sequence: Synthetic peptide
EINHSGSTNYNPSLKS

SEQ ID NO: 14915 - protein, 16 aa, Artificial Sequence
  Description of Artificial Sequence: Synthetic peptide
EINHSGSTNYNPSLKS

SEQ ID NO: 14916 - protein, 16 aa, Artificial Sequence
  Description of Artificial Sequence: Synthetic peptide
EINHSGSTNYNPSLKS

SEQ ID NO: 14917 - protein, 16 aa, Artificial Sequence
  Description of Artificial Sequence: Synthetic peptide
EINHRGSTNYNPSLKS

SEQ ID NO: 14918 - protein, 16 aa, Artificial Sequence
  Description of Artificial Sequence: Synthetic peptide
EINHSGSTNYNPSLKS

SEQ ID NO: 14919 - protein, 16 aa, Artificial Sequence
  Description of Artificial Sequence: Synthetic peptide
EINHSGSTNYNPSLKS

SEQ ID NO: 14920 - protein, 16 aa, Artificial Sequence
  Description of Artificial Sequence: Synthetic peptide
EINHSGSTNYNPSLKS

SEQ ID NO: 14921 - protein, 16 aa, Artificial Sequence
  Description of Artificial Sequence: Synthetic peptide
EINHSGSTNYNPSLKS

SEQ ID NO: 14922 - protein, 16 aa, Artificial Sequence
  Description of Artificial Sequence: Synthetic peptide
EINHSGSTNYNPSLKS

SEQ ID NO: 14923 - protein, 16 aa, Artificial Sequence
  Description of Artificial Sequence: Synthetic peptide
EINHSGSTNYNPSLKS

SEQ ID NO: 14924 - protein, 17 aa, Artificial Sequence
  Description of Artificial Sequence: Synthetic peptide
AISGSGGSTYYADSVKG

SEQ ID NO: 14925 - protein, 17 aa, Artificial Sequence
  Description of Artificial Sequence: Synthetic peptide
TISGSGGSTDYADSVKG

SEQ ID NO: 14926 - protein, 17 aa, Artificial Sequence
  Description of Artificial Sequence: Synthetic peptide
SITITGGSTYYADSVKG

SEQ ID NO: 14927 - protein, 17 aa, Artificial Sequence
  Description of Artificial Sequence: Synthetic peptide
TISHSGGSTYYADSVKG

SEQ ID NO: 14928 - protein, 17 aa, Artificial Sequence
  Description of Artificial Sequence: Synthetic peptide
TISISGGSTNYADSVKG

SEQ ID NO: 14929 - protein, 17 aa, Artificial Sequence
  Description of Artificial Sequence: Synthetic peptide
AISGSGGSTYYADSVKG

SEQ ID NO: 14930 - protein, 17 aa, Artificial Sequence
  Description of Artificial Sequence: Synthetic peptide
AISGSGGSTYYADSAKG

SEQ ID NO: 14931 - protein, 17 aa, Artificial Sequence
  Description of Artificial Sequence: Synthetic peptide
AISGSGGSTYYADSVKG

SEQ ID NO: 14932 - protein, 17 aa, Artificial Sequence
  Description of Artificial Sequence: Synthetic peptide
AISGSGGSTYYADSVKG

SEQ ID NO: 14933 - protein, 17 aa, Artificial Sequence
  Description of Artificial Sequence: Synthetic peptide
AISGSGGSTYYADSVKG

SEQ ID NO: 14934 - protein, 17 aa, Artificial Sequence
  Description of Artificial Sequence: Synthetic peptide
AISGSGGSTYYADSVKG

SEQ ID NO: 14935 - protein, 17 aa, Artificial Sequence
  Description of Artificial Sequence: Synthetic peptide
AISGSGGSTYYADSVKG

SEQ ID NO: 14936 - protein, 17 aa, Artificial Sequence
  Description of Artificial Sequence: Synthetic peptide
GISGSGGSTYYADSVKG

SEQ ID NO: 14937 - protein, 16 aa, Artificial Sequence
  Description of Artificial Sequence: Synthetic peptide
YIYYSGSTYYNPSLKS

SEQ ID NO: 14938 - protein, 16 aa, Artificial Sequence
  Description of Artificial Sequence: Synthetic peptide
YIYYSGSTYYNPSLKS

SEQ ID NO: 14939 - protein, 16 aa, Artificial Sequence
  Description of Artificial Sequence: Synthetic peptide
YINDSGSTYYNPSLKS

SEQ ID NO: 14940 - protein, 16 aa, Artificial Sequence
  Description of Artificial Sequence: Synthetic peptide
YISYSGSTFYNPSLKS

SEQ ID NO: 14941 - protein, 16 aa, Artificial Sequence
  Description of Artificial Sequence: Synthetic peptide
YIDKSGSTYYNPSLKS

SEQ ID NO: 14942 - protein, 16 aa, Artificial Sequence
  Description of Artificial Sequence: Synthetic peptide
YIDKSGSTYYNPSLKS

SEQ ID NO: 14943 - protein, 16 aa, Artificial Sequence
  Description of Artificial Sequence: Synthetic peptide
YIDKSGSTYYNPSLKS

SEQ ID NO: 14944 - protein, 16 aa, Artificial Sequence
  Description of Artificial Sequence: Synthetic peptide
YIDKSGSTYYNPSLKS

SEQ ID NO: 14945 - protein, 16 aa, Artificial Sequence
  Description of Artificial Sequence: Synthetic peptide
YISHSGSTYYNPSLKS

SEQ ID NO: 14946 - protein, 16 aa, Artificial Sequence
  Description of Artificial Sequence: Synthetic peptide
YISYSGSTFYNPSLKS

SEQ ID NO: 14947 - protein, 16 aa, Artificial Sequence
  Description of Artificial Sequence: Synthetic peptide
YIDKSGSTYYNPSLKS

SEQ ID NO: 14948 - protein, 16 aa, Artificial Sequence
  Description of Artificial Sequence: Synthetic peptide
YIDKSGSTYYNPSLKS

SEQ ID NO: 14949 - protein, 16 aa, Artificial Sequence
  Description of Artificial Sequence: Synthetic peptide
YIYYSGSTSYNPSLKS

SEQ ID NO: 14950 - protein, 16 aa, Artificial Sequence
  Description of Artificial Sequence: Synthetic peptide
YIDKSGSTYYNPSLKS

SEQ ID NO: 14951 - protein, 16 aa, Artificial Sequence
  Description of Artificial Sequence: Synthetic peptide
YISYSGSTYYNPSLKS

SEQ ID NO: 14952 - protein, 16 aa, Artificial Sequence
  Description of Artificial Sequence: Synthetic peptide
YISYSGSTYYNPSLKS

SEQ ID NO: 14953 - protein, 16 aa, Artificial Sequence
  Description of Artificial Sequence: Synthetic peptide
YISYSGSTFYNPSLKS

SEQ ID NO: 14954 - protein, 16 aa, Artificial Sequence
  Description of Artificial Sequence: Synthetic peptide
YISHSGSTYYNPSLKS

SEQ ID NO: 14955 - protein, 16 aa, Artificial Sequence
  Description of Artificial Sequence: Synthetic peptide
YISYSGSTFYNPSLKS

SEQ ID NO: 14956 - protein, 17 aa, Artificial Sequence
  Description of Artificial Sequence: Synthetic peptide
AISGSGGSTYYADSVKG

SEQ ID NO: 14957 - protein, 17 aa, Artificial Sequence
  Description of Artificial Sequence: Synthetic peptide
AISGSGGSTYYADSVKG

SEQ ID NO: 14958 - protein, 17 aa, Artificial Sequence
  Description of Artificial Sequence: Synthetic peptide
VIWYDGSNKYYADSVKG

SEQ ID NO: 14959 - protein, 17 aa, Artificial Sequence
  Description of Artificial Sequence: Synthetic peptide
LIWYDGSNKYYADSVKG

SEQ ID NO: 14960 - protein, 17 aa, Artificial Sequence
  Description of Artificial Sequence: Synthetic peptide
VIWYDGSNKYYADSVKG

SEQ ID NO: 14961 - protein, 17 aa, Artificial Sequence
  Description of Artificial Sequence: Synthetic peptide
WMNPNSGNTGYAQKFQG

SEQ ID NO: 14962 - protein, 17 aa, Artificial Sequence
  Description of Artificial Sequence: Synthetic peptide
WMNPNSGNTDYAQKFQG

SEQ ID NO: 14963 - protein, 17 aa, Artificial Sequence
  Description of Artificial Sequence: Synthetic peptide
WMNPNSGNTDYAQKFQG

SEQ ID NO: 14964 - protein, 17 aa, Artificial Sequence
  Description of Artificial Sequence: Synthetic peptide
WMNPNSGNTDYAQKFQG

SEQ ID NO: 14965 - protein, 17 aa, Artificial Sequence
  Description of Artificial Sequence: Synthetic peptide
WMNPNSGNTDYTQKFQG

SEQ ID NO: 14966 - protein, 17 aa, Artificial Sequence
  Description of Artificial Sequence: Synthetic peptide
WMNPKSGNTGYAQKFQD

SEQ ID NO: 14967 - protein, 17 aa, Artificial Sequence
  Description of Artificial Sequence: Synthetic peptide
SISSSSSYIYYADSVKG

SEQ ID NO: 14968 - protein, 17 aa, Artificial Sequence
  Description of Artificial Sequence: Synthetic peptide
SISSSSSYIYYADSVKG

SEQ ID NO: 14969 - protein, 17 aa, Artificial Sequence
  Description of Artificial Sequence: Synthetic peptide
VISYDGSNKYYADSVKG

SEQ ID NO: 14970 - protein, 17 aa, Artificial Sequence
  Description of Artificial Sequence: Synthetic peptide
VISYDGSNKYYADSVKG

SEQ ID NO: 14971 - protein, 17 aa, Artificial Sequence
  Description of Artificial Sequence: Synthetic peptide
VISYDGSNKYYADSVKG

SEQ ID NO: 14972 - protein, 16 aa, Artificial Sequence
  Description of Artificial Sequence: Synthetic peptide
YIYYSGSTNYNPSLKS

SEQ ID NO: 14973 - protein, 16 aa, Artificial Sequence
  Description of Artificial Sequence: Synthetic peptide
SIYYSGSTYYNPSLKS

SEQ ID NO: 14974 - protein, 16 aa, Artificial Sequence
  Description of Artificial Sequence: Synthetic peptide
SIYYSGSTYYNPSLKS

SEQ ID NO: 14975 - protein, 16 aa, Artificial Sequence
  Description of Artificial Sequence: Synthetic peptide
SIYYSGSTYYNPSLKS

SEQ ID NO: 14976 - protein, 16 aa, Artificial Sequence
  Description of Artificial Sequence: Synthetic peptide
SIYYSGSTYYNPSLKS

SEQ ID NO: 14977 - protein, 18 aa, Artificial Sequence
  Description of Artificial Sequence: Synthetic peptide
RTYYRSKWYNDYAVSVKS

SEQ ID NO: 14978 - protein, 18 aa, Artificial Sequence
  Description of Artificial Sequence: Synthetic peptide
RTYYRSKWYNDYAVSVKS

SEQ ID NO: 14979 - protein, 16 aa, Artificial Sequence
  Description of Artificial Sequence: Synthetic peptide
SIYHSGSTYYNPSLKS

SEQ ID NO: 14980 - protein, 16 aa, Artificial Sequence
  Description of Artificial Sequence: Synthetic peptide
SIYYGGSTYYNPSLKS

SEQ ID NO: 14981 - protein, 16 aa, Artificial Sequence
  Description of Artificial Sequence: Synthetic peptide
RIDWDDDKFYSTSLKT

SEQ ID NO: 14982 - protein, 16 aa, Artificial Sequence
  Description of Artificial Sequence: Synthetic peptide
LIYWNDDTRYSPSLQS

SEQ ID NO: 14983 - protein, 16 aa, Artificial Sequence
  Description of Artificial Sequence: Synthetic peptide
LIYWNDDKRYSPSLKS

SEQ ID NO: 14984 - protein, 16 aa, Artificial Sequence
  Description of Artificial Sequence: Synthetic peptide
LIYWNDDKRYSPSLQS

SEQ ID NO: 14985 - protein, 17 aa, Artificial Sequence
  Description of Artificial Sequence: Synthetic peptide
AISGSGGSTYYADSVKG

SEQ ID NO: 14986 - protein, 17 aa, Artificial Sequence
  Description of Artificial Sequence: Synthetic peptide
AISGSGGSTYYADSVKG

SEQ ID NO: 14987 - protein, 16 aa, Artificial Sequence
  Description of Artificial Sequence: Synthetic peptide
YIYYSGSTNYNPSLKS

SEQ ID NO: 14988 - protein, 16 aa, Artificial Sequence
  Description of Artificial Sequence: Synthetic peptide
SIYYGGSTYYNPSLKN

SEQ ID NO: 14989 - protein, 16 aa, Artificial Sequence
  Description of Artificial Sequence: Synthetic peptide
LIYWNDDKRYSPSLKS

SEQ ID NO: 14990 - protein, 16 aa, Artificial Sequence
  Description of Artificial Sequence: Synthetic peptide
LIYWNDDKRYSPSLQS

SEQ ID NO: 14991 - protein, 16 aa, Artificial Sequence
  Description of Artificial Sequence: Synthetic peptide
LIYWNDDKRYNPSLQS

SEQ ID NO: 14992 - protein, 16 aa, Artificial Sequence
  Description of Artificial Sequence: Synthetic peptide
LIYWNDDKRYSPSLQS

SEQ ID NO: 14993 - protein, 16 aa, Artificial Sequence
  Description of Artificial Sequence: Synthetic peptide
LIYWNDDKRYSPSLQS

SEQ ID NO: 14994 - protein, 16 aa, Artificial Sequence
  Description of Artificial Sequence: Synthetic peptide
LIYWNDDKRYSPSLQS

SEQ ID NO: 14995 - protein, 16 aa, Artificial Sequence
  Description of Artificial Sequence: Synthetic peptide
LIYWNDDKRYSPSLQS

SEQ ID NO: 14996 - protein, 16 aa, Artificial Sequence
  Description of Artificial Sequence: Synthetic peptide
LIYWNDDKRYSPSLQS

SEQ ID NO: 14997 - protein, 16 aa, Artificial Sequence
  Description of Artificial Sequence: Synthetic peptide
GIHIYDDKRYSPSLQS

SEQ ID NO: 14998 - protein, 16 aa, Artificial Sequence
  Description of Artificial Sequence: Synthetic peptide
LIYWNDDKRYSPSLQS

SEQ ID NO: 14999 - protein, 16 aa, Artificial Sequence
  Description of Artificial Sequence: Synthetic peptide
LIYWNDDKRYSPSLQS

SEQ ID NO: 15000 - protein, 17 aa, Artificial Sequence
  Description of Artificial Sequence: Synthetic peptide
AISGSGGSTYYADSVKG

SEQ ID NO: 15001 - protein, 17 aa, Artificial Sequence
  Description of Artificial Sequence: Synthetic peptide
GISGSGGSSYYADSVKG

SEQ ID NO: 15002 - protein, 17 aa, Artificial Sequence
  Description of Artificial Sequence: Synthetic peptide
GISGSGGSTYYADSVKG

SEQ ID NO: 15003 - protein, 16 aa, Artificial Sequence
  Description of Artificial Sequence: Synthetic peptide
YIYYSGSTYYNPSLKS

SEQ ID NO: 15004 - protein, 16 aa, Artificial Sequence
  Description of Artificial Sequence: Synthetic peptide
YIDKSGSTYYNPSLKS

SEQ ID NO: 15005 - protein, 16 aa, Artificial Sequence
  Description of Artificial Sequence: Synthetic peptide
YISHSGSTYYNPSLKS

SEQ ID NO: 15006 - protein, 16 aa, Artificial Sequence
  Description of Artificial Sequence: Synthetic peptide
YISHSGSTYYNPSLKS

SEQ ID NO: 15007 - protein, 16 aa, Artificial Sequence
  Description of Artificial Sequence: Synthetic peptide
YISYSGITNYNPSLKS

SEQ ID NO: 15008 - protein, 16 aa, Artificial Sequence
  Description of Artificial Sequence: Synthetic peptide
YISHSGSTYYNPSLKS

SEQ ID NO: 15009 - protein, 16 aa, Artificial Sequence
  Description of Artificial Sequence: Synthetic peptide
YISYSGITNYNPSLKS

SEQ ID NO: 15010 - protein, 19 aa, Artificial Sequence
  Description of Artificial Sequence: Synthetic peptide
RIKSKTDGGTTDYAAPVKG

SEQ ID NO: 15011 - protein, 19 aa, Artificial Sequence
  Description of Artificial Sequence: Synthetic peptide
RIKGNTYGGTTDYAAPVKG

SEQ ID NO: 15012 - protein, 19 aa, Artificial Sequence
  Description of Artificial Sequence: Synthetic peptide
RIKGNTYGGTTDYAAPVKG

SEQ ID NO: 15013 - protein, 19 aa, Artificial Sequence
  Description of Artificial Sequence: Synthetic peptide
RIKGNTYGGTTDYAAPVKG

SEQ ID NO: 15014 - protein, 19 aa, Artificial Sequence
  Description of Artificial Sequence: Synthetic peptide
RIKGNTYGGTTDYAAPVKG

SEQ ID NO: 15015 - protein, 19 aa, Artificial Sequence
  Description of Artificial Sequence: Synthetic peptide
RIKGNTYGGTTDYAAPVKG

SEQ ID NO: 15016 - protein, 19 aa, Artificial Sequence
  Description of Artificial Sequence: Synthetic peptide
RIKGNTYGGTTDYAAPVKG

SEQ ID NO: 15017 - protein, 19 aa, Artificial Sequence
  Description of Artificial Sequence: Synthetic peptide
RIKGNTYGGTTDYAAPVKG

SEQ ID NO: 15018 - protein, 19 aa, Artificial Sequence
  Description of Artificial Sequence: Synthetic peptide
RIKSKTYGGTTDYAAPVKG

SEQ ID NO: 15019 - protein, 19 aa, Artificial Sequence
  Description of Artificial Sequence: Synthetic peptide
RIKGNTYGGTTDYAAPVKG

SEQ ID NO: 15020 - protein, 19 aa, Artificial Sequence
  Description of Artificial Sequence: Synthetic peptide
RIKGNTYGGTTDYAAPVKG

SEQ ID NO: 15021 - protein, 19 aa, Artificial Sequence
  Description of Artificial Sequence: Synthetic peptide
RIKGNTYGGTTDYAAPVKG

SEQ ID NO: 15022 - protein, 19 aa, Artificial Sequence
  Description of Artificial Sequence: Synthetic peptide
RIKGNTYGGTTDYAAPVKG

SEQ ID NO: 15023 - protein, 19 aa, Artificial Sequence
  Description of Artificial Sequence: Synthetic peptide
RIKGNTYGGTTDYAAPVKG

SEQ ID NO: 15024 - protein, 19 aa, Artificial Sequence
  Description of Artificial Sequence: Synthetic peptide
RIKGNTYGGTTDYAAPVKG

SEQ ID NO: 15025 - protein, 19 aa, Artificial Sequence
  Description of Artificial Sequence: Synthetic peptide
RIKGNTYGGTTDYAAPVKG

SEQ ID NO: 15026 - protein, 19 aa, Artificial Sequence
  Description of Artificial Sequence: Synthetic peptide
RIKGNTYGGTTDYAAPVKG

SEQ ID NO: 15027 - protein, 19 aa, Artificial Sequence
  Description of Artificial Sequence: Synthetic peptide
RIKSKTYGGTTDYAAPVKG

SEQ ID NO: 15028 - protein, 19 aa, Artificial Sequence
  Description of Artificial Sequence: Synthetic peptide
RIRSRSYGGTTDYAAPVKG

SEQ ID NO: 15029 - protein, 19 aa, Artificial Sequence
  Description of Artificial Sequence: Synthetic peptide
RIKSKTYGGTTDYAAPVKG

SEQ ID NO: 15030 - protein, 19 aa, Artificial Sequence
  Description of Artificial Sequence: Synthetic peptide
RITSSRYGGTTDYAAPVKG

SEQ ID NO: 15031 - protein, 19 aa, Artificial Sequence
  Description of Artificial Sequence: Synthetic peptide
RILNNAYGGTTDYAAPVKG

SEQ ID NO: 15032 - protein, 19 aa, Artificial Sequence
  Description of Artificial Sequence: Synthetic peptide
RITSGIYGGTTDYAAPVKG

SEQ ID NO: 15033 - protein, 19 aa, Artificial Sequence
  Description of Artificial Sequence: Synthetic peptide
RIRSRPYGGTTDYAAPVKG

SEQ ID NO: 15034 - protein, 16 aa, Artificial Sequence
  Description of Artificial Sequence: Synthetic peptide
YIYYSGSTNYNPSLKS

SEQ ID NO: 15035 - protein, 16 aa, Artificial Sequence
  Description of Artificial Sequence: Synthetic peptide
HIYTSGSTNYNPSLKS

SEQ ID NO: 15036 - protein, 16 aa, Artificial Sequence
  Description of Artificial Sequence: Synthetic peptide
YIYYRGSTNYHPSLKS

SEQ ID NO: 15037 - protein, 16 aa, Artificial Sequence
  Description of Artificial Sequence: Synthetic peptide
HIYTSGSTNFNPSLKS

SEQ ID NO: 15038 - protein, 17 aa, Artificial Sequence
  Description of Artificial Sequence: Synthetic peptide
AISGSGGSTYYADSVKG

SEQ ID NO: 15039 - protein, 17 aa, Artificial Sequence
  Description of Artificial Sequence: Synthetic peptide
AISGSGGSTYYADSVKG

SEQ ID NO: 15040 - protein, 17 aa, Artificial Sequence
  Description of Artificial Sequence: Synthetic peptide
AISGSGGGTYYADSVKG

SEQ ID NO: 15041 - protein, 17 aa, Artificial Sequence
  Description of Artificial Sequence: Synthetic peptide
TISGSGGGTYYADSVKG

SEQ ID NO: 15042 - protein, 17 aa, Artificial Sequence
  Description of Artificial Sequence: Synthetic peptide
AISGSGGGTYYADSVKG

SEQ ID NO: 15043 - protein, 17 aa, Artificial Sequence
  Description of Artificial Sequence: Synthetic peptide
AISGSGGGTYNADSVKG

SEQ ID NO: 15044 - protein, 17 aa, Artificial Sequence
  Description of Artificial Sequence: Synthetic peptide
AISGSGGGTYYADSVKG

SEQ ID NO: 15045 - protein, 17 aa, Artificial Sequence
  Description of Artificial Sequence: Synthetic peptide
AISGSGGGTYNADSVKG

SEQ ID NO: 15046 - protein, 17 aa, Artificial Sequence
  Description of Artificial Sequence: Synthetic peptide
AISGSGGGTYYADSVKA

SEQ ID NO: 15047 - protein, 17 aa, Artificial Sequence
  Description of Artificial Sequence: Synthetic peptide
AISGSGGGTYYADSVKG

SEQ ID NO: 15048 - protein, 17 aa, Artificial Sequence
  Description of Artificial Sequence: Synthetic peptide
AISGSGGGTYYADSVKG

SEQ ID NO: 15049 - protein, 17 aa, Artificial Sequence
  Description of Artificial Sequence: Synthetic peptide
AISGSGGGTYYADSVKG

SEQ ID NO: 15050 - protein, 17 aa, Artificial Sequence
  Description of Artificial Sequence: Synthetic peptide
AISGSGGGTYYADSVKG

SEQ ID NO: 15051 - protein, 17 aa, Artificial Sequence
  Description of Artificial Sequence: Synthetic peptide
AISGSGGGTYYADSVKG

SEQ ID NO: 15052 - protein, 17 aa, Artificial Sequence
  Description of Artificial Sequence: Synthetic peptide
TISGSGGGTYYADSVKG

SEQ ID NO: 15053 - protein, 17 aa, Artificial Sequence
  Description of Artificial Sequence: Synthetic peptide
TISGSGGGTYYADSVKG

SEQ ID NO: 15054 - protein, 17 aa, Artificial Sequence
  Description of Artificial Sequence: Synthetic peptide
AISGSGGGTYYADSGKG

SEQ ID NO: 15055 - protein, 17 aa, Artificial Sequence
  Description of Artificial Sequence: Synthetic peptide
TISGSGGGTYYADSVKG

SEQ ID NO: 15056 - protein, 17 aa, Artificial Sequence
  Description of Artificial Sequence: Synthetic peptide
AISGSGGGTYYADSVKG

SEQ ID NO: 15057 - protein, 17 aa, Artificial Sequence
  Description of Artificial Sequence: Synthetic peptide
TISGSGGGTYYADSVKG

SEQ ID NO: 15058 - protein, 17 aa, Artificial Sequence
  Description of Artificial Sequence: Synthetic peptide
AISGSGGGTYYADSVKG

SEQ ID NO: 15059 - protein, 17 aa, Artificial Sequence
  Description of Artificial Sequence: Synthetic peptide
AISGSGGGTYYADSVKG

SEQ ID NO: 15060 - protein, 17 aa, Artificial Sequence
  Description of Artificial Sequence: Synthetic peptide
AISGSGGGTYYADSVKG

SEQ ID NO: 15061 - protein, 17 aa, Artificial Sequence
  Description of Artificial Sequence: Synthetic peptide
AISGSGGGTYYADSVKG

SEQ ID NO: 15062 - protein, 17 aa, Artificial Sequence
  Description of Artificial Sequence: Synthetic peptide
AISGSGGGTYYADSVKA

SEQ ID NO: 15063 - protein, 17 aa, Artificial Sequence
  Description of Artificial Sequence: Synthetic peptide
AISGSGGGTYYADSVKG

SEQ ID NO: 15064 - protein, 17 aa, Artificial Sequence
  Description of Artificial Sequence: Synthetic peptide
AISGSGGGTYYADSVKG

SEQ ID NO: 15065 - protein, 17 aa, Artificial Sequence
  Description of Artificial Sequence: Synthetic peptide
TISGSGGGTYYADSVKG

SEQ ID NO: 15066 - protein, 17 aa, Artificial Sequence
  Description of Artificial Sequence: Synthetic peptide
AISGSGGGTYYADSVKG

SEQ ID NO: 15067 - protein, 17 aa, Artificial Sequence
  Description of Artificial Sequence: Synthetic peptide
AISGSGGGTYYADSVKG

SEQ ID NO: 15068 - protein, 17 aa, Artificial Sequence
  Description of Artificial Sequence: Synthetic peptide
AISGSGGGTYNADSVKG

SEQ ID NO: 15069 - protein, 17 aa, Artificial Sequence
  Description of Artificial Sequence: Synthetic peptide
AISGSGGGTYYADSVKG

SEQ ID NO: 15070 - protein, 17 aa, Artificial Sequence
  Description of Artificial Sequence: Synthetic peptide
AISGSGGGTYYADSVKA

SEQ ID NO: 15071 - protein, 17 aa, Artificial Sequence
  Description of Artificial Sequence: Synthetic peptide
AISGSGGGTYNADSVKG

SEQ ID NO: 15072 - protein, 17 aa, Artificial Sequence
  Description of Artificial Sequence: Synthetic peptide
AISGSGGGTYYADSVKG

SEQ ID NO: 15073 - protein, 17 aa, Artificial Sequence
  Description of Artificial Sequence: Synthetic peptide
AISGSGGGTYYADSVKA

SEQ ID NO: 15074 - protein, 17 aa, Artificial Sequence
  Description of Artificial Sequence: Synthetic peptide
AISGSGGGTYYADSVKG

SEQ ID NO: 15075 - protein, 17 aa, Artificial Sequence
  Description of Artificial Sequence: Synthetic peptide
AISGSGGGTYYADSVKG

SEQ ID NO: 15076 - protein, 17 aa, Artificial Sequence
  Description of Artificial Sequence: Synthetic peptide
AISGSGGGTYNADSVKG

SEQ ID NO: 15077 - protein, 17 aa, Artificial Sequence
  Description of Artificial Sequence: Synthetic peptide
TISGSGGGTYYADSVKG

SEQ ID NO: 15078 - protein, 17 aa, Artificial Sequence
  Description of Artificial Sequence: Synthetic peptide
AISGSGGGTYYADSGKG

SEQ ID NO: 15079 - protein, 17 aa, Artificial Sequence
  Description of Artificial Sequence: Synthetic peptide
SISGSGGGTYYAASVKG

SEQ ID NO: 15080 - protein, 17 aa, Artificial Sequence
  Description of Artificial Sequence: Synthetic peptide
AISGSGGGTYYADSVKG

SEQ ID NO: 15081 - protein, 17 aa, Artificial Sequence
  Description of Artificial Sequence: Synthetic peptide
TISGSGGGTYYADSVKG

SEQ ID NO: 15082 - protein, 17 aa, Artificial Sequence
  Description of Artificial Sequence: Synthetic peptide
SISGSGGGTYYAASVKG

SEQ ID NO: 15083 - protein, 17 aa, Artificial Sequence
  Description of Artificial Sequence: Synthetic peptide
AISGSGGGTYNADSVKG

SEQ ID NO: 15084 - protein, 17 aa, Artificial Sequence
  Description of Artificial Sequence: Synthetic peptide
AISGSGGGTYYAASVKG

SEQ ID NO: 15085 - protein, 17 aa, Artificial Sequence
  Description of Artificial Sequence: Synthetic peptide
AISGSGGGTYYAASVKG

SEQ ID NO: 15086 - protein, 17 aa, Artificial Sequence
  Description of Artificial Sequence: Synthetic peptide
SISGSGGGTYYAASVKG

SEQ ID NO: 15087 - protein, 17 aa, Artificial Sequence
  Description of Artificial Sequence: Synthetic peptide
TISGSGGGTYYADSVKG

SEQ ID NO: 15088 - protein, 17 aa, Artificial Sequence
  Description of Artificial Sequence: Synthetic peptide
TISGSGGGTYYAASVKG

SEQ ID NO: 15089 - protein, 17 aa, Artificial Sequence
  Description of Artificial Sequence: Synthetic peptide
AISGSGGGTYNAASVKG

SEQ ID NO: 15090 - protein, 17 aa, Artificial Sequence
  Description of Artificial Sequence: Synthetic peptide
AISGSGGGTYYADSVKG

SEQ ID NO: 15091 - protein, 17 aa, Artificial Sequence
  Description of Artificial Sequence: Synthetic peptide
AISGSGGGTYYAASVKG

SEQ ID NO: 15092 - protein, 17 aa, Artificial Sequence
  Description of Artificial Sequence: Synthetic peptide
AISGSGGGTYYADSVKG

SEQ ID NO: 15093 - protein, 17 aa, Artificial Sequence
  Description of Artificial Sequence: Synthetic peptide
AISGSGGGTYYAASVKG

SEQ ID NO: 15094 - protein, 17 aa, Artificial Sequence
  Description of Artificial Sequence: Synthetic peptide
AISGSGGGTYNADSVKG

SEQ ID NO: 15095 - protein, 17 aa, Artificial Sequence
  Description of Artificial Sequence: Synthetic peptide
AISGSGGGTYNAASVKG

SEQ ID NO: 15096 - protein, 17 aa, Artificial Sequence
  Description of Artificial Sequence: Synthetic peptide
AISGSGGSTYYADSVKG

SEQ ID NO: 15097 - protein, 17 aa, Artificial Sequence
  Description of Artificial Sequence: Synthetic peptide
AISGSGGGTYYADSVKG

SEQ ID NO: 15098 - protein, 17 aa, Artificial Sequence
  Description of Artificial Sequence: Synthetic peptide
VISYDGSNKYYADSVKG

SEQ ID NO: 15099 - protein, 17 aa, Artificial Sequence
  Description of Artificial Sequence: Synthetic peptide
VISYDGSNKYYADSVKG

SEQ ID NO: 15100 - protein, 17 aa, Artificial Sequence
  Description of Artificial Sequence: Synthetic peptide
VISYDAETVKYAESVKG

SEQ ID NO: 15101 - protein, 17 aa, Artificial Sequence
  Description of Artificial Sequence: Synthetic peptide
VISYDASNKYYAESVKG

SEQ ID NO: 15102 - protein, 17 aa, Artificial Sequence
  Description of Artificial Sequence: Synthetic peptide
WISAYNGNTNYAQKLQG

SEQ ID NO: 15103 - protein, 17 aa, Artificial Sequence
  Description of Artificial Sequence: Synthetic peptide
WISGYNGDTNYAQKLQG

SEQ ID NO: 15104 - protein, 17 aa, Artificial Sequence
  Description of Artificial Sequence: Synthetic peptide
WISGYNGDTNYAQKLQG

SEQ ID NO: 15105 - protein, 17 aa, Artificial Sequence
  Description of Artificial Sequence: Synthetic peptide
YISSSGSTIYYADSVKG

SEQ ID NO: 15106 - protein, 17 aa, Artificial Sequence
  Description of Artificial Sequence: Synthetic peptide
YISKSGSTIYYADSVKG

SEQ ID NO: 15107 - protein, 17 aa, Artificial Sequence
  Description of Artificial Sequence: Synthetic peptide
YISKSSYTVTYADAVKG

SEQ ID NO: 15108 - protein, 32 aa, Artificial Sequence; identical to SEQ ID NO: 1367
  Description of Artificial Sequence: Synthetic polypeptide

SEQ ID NO: 15109 - protein, 32 aa, Artificial Sequence; identical to SEQ ID NO: 4214
  Description of Artificial Sequence: Synthetic polypeptide

SEQ ID NO: 15110 - protein, 32 aa, Artificial Sequence; identical to SEQ ID NO: 1367
  Description of Artificial Sequence: Synthetic polypeptide

SEQ ID NO: 15111 - protein, 32 aa, Artificial Sequence; identical to SEQ ID NO: 1367
  Description of Artificial Sequence: Synthetic polypeptide

SEQ ID NO: 15112 - protein, 32 aa, Artificial Sequence; identical to SEQ ID NO: 4215
  Description of Artificial Sequence: Synthetic polypeptide

SEQ ID NO: 15113 - protein, 32 aa, Artificial Sequence; identical to SEQ ID NO: 4216
  Description of Artificial Sequence: Synthetic polypeptide

SEQ ID NO: 15114 - protein, 32 aa, Artificial Sequence; identical to SEQ ID NO: 1346
  Description of Artificial Sequence: Synthetic polypeptide

SEQ ID NO: 15115 - protein, 32 aa, Artificial Sequence; identical to SEQ ID NO: 4218
  Description of Artificial Sequence: Synthetic polypeptide

SEQ ID NO: 15116 - protein, 32 aa, Artificial Sequence; identical to SEQ ID NO: 1372
  Description of Artificial Sequence: Synthetic polypeptide

SEQ ID NO: 15117 - protein, 32 aa, Artificial Sequence; identical to SEQ ID NO: 4220
  Description of Artificial Sequence: Synthetic polypeptide

SEQ ID NO: 15118 - protein, 32 aa, Artificial Sequence; identical to SEQ ID NO: 1372
  Description of Artificial Sequence: Synthetic polypeptide

SEQ ID NO: 15119 - protein, 32 aa, Artificial Sequence; identical to SEQ ID NO: 1372
  Description of Artificial Sequence: Synthetic polypeptide

SEQ ID NO: 15120 - protein, 32 aa, Artificial Sequence; identical to SEQ ID NO: 1372
  Description of Artificial Sequence: Synthetic polypeptide

SEQ ID NO: 15121 - protein, 32 aa, Artificial Sequence; identical to SEQ ID NO: 1372
  Description of Artificial Sequence: Synthetic polypeptide

SEQ ID NO: 15122 - protein, 32 aa, Artificial Sequence; identical to SEQ ID NO: 1372
  Description of Artificial Sequence: Synthetic polypeptide

SEQ ID NO: 15123 - protein, 32 aa, Artificial Sequence; identical to SEQ ID NO: 1372
  Description of Artificial Sequence: Synthetic polypeptide

SEQ ID NO: 15124 - protein, 32 aa, Artificial Sequence; identical to SEQ ID NO: 11915
  Description of Artificial Sequence: Synthetic polypeptide

SEQ ID NO: 15125 - protein, 32 aa, Artificial Sequence; identical to SEQ ID NO: 11916
  Description of Artificial Sequence: Synthetic polypeptide

SEQ ID NO: 15126 - protein, 32 aa, Artificial Sequence; identical to SEQ ID NO: 11916
  Description of Artificial Sequence: Synthetic polypeptide

SEQ ID NO: 15127 - protein, 32 aa, Artificial Sequence; identical to SEQ ID NO: 11918
  Description of Artificial Sequence: Synthetic polypeptide

SEQ ID NO: 15128 - protein, 32 aa, Artificial Sequence; identical to SEQ ID NO: 1372
  Description of Artificial Sequence: Synthetic polypeptide

SEQ ID NO: 15129 - protein, 32 aa, Artificial Sequence; identical to SEQ ID NO: 1372
  Description of Artificial Sequence: Synthetic polypeptide

SEQ ID NO: 15130 - protein, 32 aa, Artificial Sequence; identical to SEQ ID NO: 11921
  Description of Artificial Sequence: Synthetic polypeptide

SEQ ID NO: 15131 - protein, 32 aa, Artificial Sequence; identical to SEQ ID NO: 11918
  Description of Artificial Sequence: Synthetic polypeptide

SEQ ID NO: 15132 - protein, 32 aa, Artificial Sequence; identical to SEQ ID NO: 11923
  Description of Artificial Sequence: Synthetic polypeptide

SEQ ID NO: 15133 - protein, 32 aa, Artificial Sequence; identical to SEQ ID NO: 1373
  Description of Artificial Sequence: Synthetic polypeptide

SEQ ID NO: 15134 - protein, 32 aa, Artificial Sequence; identical to SEQ ID NO: 11916
  Description of Artificial Sequence: Synthetic polypeptide

SEQ ID NO: 15135 - protein, 32 aa, Artificial Sequence; identical to SEQ ID NO: 1373
  Description of Artificial Sequence: Synthetic polypeptide

SEQ ID NO: 15136 - protein, 32 aa, Artificial Sequence; identical to SEQ ID NO: 4211
  Description of Artificial Sequence: Synthetic polypeptide

SEQ ID NO: 15137 - protein, 32 aa, Artificial Sequence; identical to SEQ ID NO: 4211
  Description of Artificial Sequence: Synthetic polypeptide

SEQ ID NO: 15138 - protein, 32 aa, Artificial Sequence; identical to SEQ ID NO: 4211
  Description of Artificial Sequence: Synthetic polypeptide

SEQ ID NO: 15139 - protein, 32 aa, Artificial Sequence; identical to SEQ ID NO: 4211
  Description of Artificial Sequence: Synthetic polypeptide

SEQ ID NO: 15140 - protein, 32 aa, Artificial Sequence; identical to SEQ ID NO: 4211
  Description of Artificial Sequence: Synthetic polypeptide

SEQ ID NO: 15141 - protein, 32 aa, Artificial Sequence; identical to SEQ ID NO: 4211
  Description of Artificial Sequence: Synthetic polypeptide

SEQ ID NO: 15142 - protein, 32 aa, Artificial Sequence; identical to SEQ ID NO: 4211
  Description of Artificial Sequence: Synthetic polypeptide

SEQ ID NO: 15143 - protein, 32 aa, Artificial Sequence; identical to SEQ ID NO: 11934
  Description of Artificial Sequence: Synthetic polypeptide

SEQ ID NO: 15144 - protein, 32 aa, Artificial Sequence; identical to SEQ ID NO: 4211
  Description of Artificial Sequence: Synthetic polypeptide

SEQ ID NO: 15145 - protein, 32 aa, Artificial Sequence; identical to SEQ ID NO: 1372
  Description of Artificial Sequence: Synthetic polypeptide

SEQ ID NO: 15146 - protein, 32 aa, Artificial Sequence; identical to SEQ ID NO: 1372
  Description of Artificial Sequence: Synthetic polypeptide

SEQ ID NO: 15147 - protein, 32 aa, Artificial Sequence; identical to SEQ ID NO: 11938
  Description of Artificial Sequence: Synthetic polypeptide

SEQ ID NO: 15148 - protein, 32 aa, Artificial Sequence; identical to SEQ ID NO: 11939
  Description of Artificial Sequence: Synthetic polypeptide

SEQ ID NO: 15149 - protein, 32 aa, Artificial Sequence; identical to SEQ ID NO: 11940
  Description of Artificial Sequence: Synthetic polypeptide

SEQ ID NO: 15150 - protein, 32 aa, Artificial Sequence; identical to SEQ ID NO: 1372
  Description of Artificial Sequence: Synthetic polypeptide

SEQ ID NO: 15151 - protein, 32 aa, Artificial Sequence; identical to SEQ ID NO: 1372
  Description of Artificial Sequence: Synthetic polypeptide

SEQ ID NO: 15152 - protein, 32 aa, Artificial Sequence; identical to SEQ ID NO: 1372
  Description of Artificial Sequence: Synthetic polypeptide

SEQ ID NO: 15153 - protein, 32 aa, Artificial Sequence; identical to SEQ ID NO: 1372
  Description of Artificial Sequence: Synthetic polypeptide

SEQ ID NO: 15154 - protein, 32 aa, Artificial Sequence; identical to SEQ ID NO: 11945
  Description of Artificial Sequence: Synthetic polypeptide

SEQ ID NO: 15155 - protein, 32 aa, Artificial Sequence; identical to SEQ ID NO: 11946
  Description of Artificial Sequence: Synthetic polypeptide

SEQ ID NO: 15156 - protein, 32 aa, Artificial Sequence; identical to SEQ ID NO: 1372
  Description of Artificial Sequence: Synthetic polypeptide

SEQ ID NO: 15157 - protein, 32 aa, Artificial Sequence; identical to SEQ ID NO: 1346
  Description of Artificial Sequence: Synthetic polypeptide

SEQ ID NO: 15158 - protein, 32 aa, Artificial Sequence; identical to SEQ ID NO: 1346
  Description of Artificial Sequence: Synthetic polypeptide

SEQ ID NO: 15159 - protein, 32 aa, Artificial Sequence; identical to SEQ ID NO: 11950
  Description of Artificial Sequence: Synthetic polypeptide

SEQ ID NO: 15160 - protein, 32 aa, Artificial Sequence; identical to SEQ ID NO: 1372
  Description of Artificial Sequence: Synthetic polypeptide

SEQ ID NO: 15161 - protein, 32 aa, Artificial Sequence; identical to SEQ ID NO: 1372
  Description of Artificial Sequence: Synthetic polypeptide

SEQ ID NO: 15162 - protein, 32 aa, Artificial Sequence; identical to SEQ ID NO: 1372
  Description of Artificial Sequence: Synthetic polypeptide

SEQ ID NO: 15163 - protein, 32 aa, Artificial Sequence; identical to SEQ ID NO: 11954
  Description of Artificial Sequence: Synthetic polypeptide

SEQ ID NO: 15164 - protein, 32 aa, Artificial Sequence; identical to SEQ ID NO: 11955
  Description of Artificial Sequence: Synthetic polypeptide

SEQ ID NO: 15165 - protein, 32 aa, Artificial Sequence; identical to SEQ ID NO: 11956
  Description of Artificial Sequence: Synthetic polypeptide

SEQ ID NO: 15166 - protein, 32 aa, Artificial Sequence; identical to SEQ ID NO: 1372
  Description of Artificial Sequence: Synthetic polypeptide

SEQ ID NO: 15167 - protein, 32 aa, Artificial Sequence; identical to SEQ ID NO: 4220
  Description of Artificial Sequence: Synthetic polypeptide

SEQ ID NO: 15168 - protein, 32 aa, Artificial Sequence; identical to SEQ ID NO: 11959
  Description of Artificial Sequence: Synthetic polypeptide

SEQ ID NO: 15169 - protein, 32 aa, Artificial Sequence; identical to SEQ ID NO: 1346
  Description of Artificial Sequence: Synthetic polypeptide

SEQ ID NO: 15170 - protein, 32 aa, Artificial Sequence; identical to SEQ ID NO: 1346
  Description of Artificial Sequence: Synthetic polypeptide

SEQ ID NO: 15171 - protein, 32 aa, Artificial Sequence; identical to SEQ ID NO: 1346
  Description of Artificial Sequence: Synthetic polypeptide

SEQ ID NO: 15172 - protein, 32 aa, Artificial Sequence; identical to SEQ ID NO: 11963
  Description of Artificial Sequence: Synthetic polypeptide

SEQ ID NO: 15173 - protein, 32 aa, Artificial Sequence; identical to SEQ ID NO: 1346
  Description of Artificial Sequence: Synthetic polypeptide

SEQ ID NO: 15174 - protein, 32 aa, Artificial Sequence; identical to SEQ ID NO: 1350
  Description of Artificial Sequence: Synthetic polypeptide

SEQ ID NO: 15175 - protein, 32 aa, Artificial Sequence; identical to SEQ ID NO: 1346
  Description of Artificial Sequence: Synthetic polypeptide

SEQ ID NO: 15176 - protein, 32 aa, Artificial Sequence; identical to SEQ ID NO: 1350
  Description of Artificial Sequence: Synthetic polypeptide

SEQ ID NO: 15177 - protein, 32 aa, Artificial Sequence; identical to SEQ ID NO: 1372
  Description of Artificial Sequence: Synthetic polypeptide

SEQ ID NO: 15178 - protein, 32 aa, Artificial Sequence; identical to SEQ ID NO: 1372
  Description of Artificial Sequence: Synthetic polypeptide

SEQ ID NO: 15179 - protein, 32 aa, Artificial Sequence; identical to SEQ ID NO: 1372
  Description of Artificial Sequence: Synthetic polypeptide

SEQ ID NO: 15180 - protein, 32 aa, Artificial Sequence; identical to SEQ ID NO: 1372
  Description of Artificial Sequence: Synthetic polypeptide

SEQ ID NO: 15181 - protein, 32 aa, Artificial Sequence; identical to SEQ ID NO: 1372
  Description of Artificial Sequence: Synthetic polypeptide

SEQ ID NO: 15182 - protein, 32 aa, Artificial Sequence; identical to SEQ ID NO: 1372
  Description of Artificial Sequence: Synthetic polypeptide

SEQ ID NO: 15183 - protein, 32 aa, Artificial Sequence; identical to SEQ ID NO: 1372
  Description of Artificial Sequence: Synthetic polypeptide

SEQ ID NO: 15184 - protein, 32 aa, Artificial Sequence; identical to SEQ ID NO: 1372
  Description of Artificial Sequence: Synthetic polypeptide

SEQ ID NO: 15185 - protein, 32 aa, Artificial Sequence; identical to SEQ ID NO: 11918
  Description of Artificial Sequence: Synthetic polypeptide

SEQ ID NO: 15186 - protein, 32 aa, Artificial Sequence; identical to SEQ ID NO: 1372
  Description of Artificial Sequence: Synthetic polypeptide

SEQ ID NO: 15187 - protein, 32 aa, Artificial Sequence; identical to SEQ ID NO: 11946
  Description of Artificial Sequence: Synthetic polypeptide

SEQ ID NO: 15188 - protein, 32 aa, Artificial Sequence; identical to SEQ ID NO: 11918
  Description of Artificial Sequence: Synthetic polypeptide

SEQ ID NO: 15189 - protein, 32 aa, Artificial Sequence; identical to SEQ ID NO: 4220
  Description of Artificial Sequence: Synthetic polypeptide

SEQ ID NO: 15190 - protein, 32 aa, Artificial Sequence; identical to SEQ ID NO: 1372
  Description of Artificial Sequence: Synthetic polypeptide

SEQ ID NO: 15191 - protein, 32 aa, Artificial Sequence; identical to SEQ ID NO: 1372
  Description of Artificial Sequence: Synthetic polypeptide

SEQ ID NO: 15192 - protein, 32 aa, Artificial Sequence; identical to SEQ ID NO: 1372
  Description of Artificial Sequence: Synthetic polypeptide

SEQ ID NO: 15193 - protein, 32 aa, Artificial Sequence; identical to SEQ ID NO: 1372
  Description of Artificial Sequence: Synthetic polypeptide

SEQ ID NO: 15194 - protein, 32 aa, Artificial Sequence; identical to SEQ ID NO: 1369
  Description of Artificial Sequence: Synthetic polypeptide

SEQ ID NO: 15195 - protein, 32 aa, Artificial Sequence; identical to SEQ ID NO: 1346
  Description of Artificial Sequence: Synthetic polypeptide

SEQ ID NO: 15196 - protein, 32 aa, Artificial Sequence; identical to SEQ ID NO: 1369
  Description of Artificial Sequence: Synthetic polypeptide

SEQ ID NO: 15197 - protein, 32 aa, Artificial Sequence; identical to SEQ ID NO: 1369
  Description of Artificial Sequence: Synthetic polypeptide

SEQ ID NO: 15198 - protein, 32 aa, Artificial Sequence; identical to SEQ ID NO: 1369
  Description of Artificial Sequence: Synthetic polypeptide

SEQ ID NO: 15199 - protein, 32 aa, Artificial Sequence; identical to SEQ ID NO: 1369
  Description of Artificial Sequence: Synthetic polypeptide

SEQ ID NO: 15200 - protein, 32 aa, Artificial Sequence; identical to SEQ ID NO: 1346
  Description of Artificial Sequence: Synthetic polypeptide

SEQ ID NO: 15201 - protein, 32 aa, Artificial Sequence; identical to SEQ ID NO: 1372
  Description of Artificial Sequence: Synthetic polypeptide

SEQ ID NO: 15202 - protein, 32 aa, Artificial Sequence; identical to SEQ ID NO: 1372
  Description of Artificial Sequence: Synthetic polypeptide

SEQ ID NO: 15203 - protein, 32 aa, Artificial Sequence; identical to SEQ ID NO: 1369
  Description of Artificial Sequence: Synthetic polypeptide

SEQ ID NO: 15204 - protein, 32 aa, Artificial Sequence; identical to SEQ ID NO: 1346
  Description of Artificial Sequence: Synthetic polypeptide

SEQ ID NO: 15205 - protein, 32 aa, Artificial Sequence; identical to SEQ ID NO: 1372
  Description of Artificial Sequence: Synthetic polypeptide

SEQ ID NO: 15206 - protein, 32 aa, Artificial Sequence; identical to SEQ ID NO: 1372
  Description of Artificial Sequence: Synthetic polypeptide

SEQ ID NO: 15207 - protein, 32 aa, Artificial Sequence; identical to SEQ ID NO: 1367
  Description of Artificial Sequence: Synthetic polypeptide

SEQ ID NO: 15208 - protein, 32 aa, Artificial Sequence; identical to SEQ ID NO: 1367
  Description of Artificial Sequence: Synthetic polypeptide

SEQ ID NO: 15209 - protein, 32 aa, Artificial Sequence; identical to SEQ ID NO: 1367
  Description of Artificial Sequence: Synthetic polypeptide

SEQ ID NO: 15210 - protein, 32 aa, Artificial Sequence; identical to SEQ ID NO: 1367
  Description of Artificial Sequence: Synthetic polypeptide

SEQ ID NO: 15211 - protein, 32 aa, Artificial Sequence; identical to SEQ ID NO: 12002
  Description of Artificial Sequence: Synthetic polypeptide

SEQ ID NO: 15212 - protein, 32 aa, Artificial Sequence; identical to SEQ ID NO: 12003
  Description of Artificial Sequence: Synthetic polypeptide

SEQ ID NO: 15213 - protein, 32 aa, Artificial Sequence; identical to SEQ ID NO: 1367
  Description of Artificial Sequence: Synthetic polypeptide

SEQ ID NO: 15214 - protein, 32 aa, Artificial Sequence; identical to SEQ ID NO: 1367
  Description of Artificial Sequence: Synthetic polypeptide

SEQ ID NO: 15215 - protein, 32 aa, Artificial Sequence; identical to SEQ ID NO: 1367
  Description of Artificial Sequence: Synthetic polypeptide

SEQ ID NO: 15216 - protein, 32 aa, Artificial Sequence; identical to SEQ ID NO: 1367
  Description of Artificial Sequence: Synthetic polypeptide

SEQ ID NO: 15217 - protein, 32 aa, Artificial Sequence; identical to SEQ ID NO: 1367
  Description of Artificial Sequence: Synthetic polypeptide

SEQ ID NO: 15218 - protein, 32 aa, Artificial Sequence; identical to SEQ ID NO: 1346
  Description of Artificial Sequence: Synthetic polypeptide

SEQ ID NO: 15219 - protein, 32 aa, Artificial Sequence; identical to SEQ ID NO: 1346
  Description of Artificial Sequence: Synthetic polypeptide

SEQ ID NO: 15220 - protein, 32 aa, Artificial Sequence; identical to SEQ ID NO: 1346
  Description of Artificial Sequence: Synthetic polypeptide

SEQ ID NO: 15221 - protein, 32 aa, Artificial Sequence; identical to SEQ ID NO: 1346
  Description of Artificial Sequence: Synthetic polypeptide

SEQ ID NO: 15222 - protein, 32 aa, Artificial Sequence; identical to SEQ ID NO: 1346
  Description of Artificial Sequence: Synthetic polypeptide

SEQ ID NO: 15223 - protein, 32 aa, Artificial Sequence; identical to SEQ ID NO: 1346
  Description of Artificial Sequence: Synthetic polypeptide

SEQ ID NO: 15224 - protein, 32 aa, Artificial Sequence; identical to SEQ ID NO: 1346
  Description of Artificial Sequence: Synthetic polypeptide

SEQ ID NO: 15225 - protein, 32 aa, Artificial Sequence; identical to SEQ ID NO: 1346
  Description of Artificial Sequence: Synthetic polypeptide

SEQ ID NO: 15226 - protein, 32 aa, Artificial Sequence; identical to SEQ ID NO: 1346
  Description of Artificial Sequence: Synthetic polypeptide

SEQ ID NO: 15227 - protein, 32 aa, Artificial Sequence; identical to SEQ ID NO: 1346
  Description of Artificial Sequence: Synthetic polypeptide

SEQ ID NO: 15228 - protein, 32 aa, Artificial Sequence; identical to SEQ ID NO: 1346
  Description of Artificial Sequence: Synthetic polypeptide

SEQ ID NO: 15229 - protein, 32 aa, Artificial Sequence; identical to SEQ ID NO: 1346
  Description of Artificial Sequence: Synthetic polypeptide

SEQ ID NO: 15230 - protein, 32 aa, Artificial Sequence; identical to SEQ ID NO: 1346
  Description of Artificial Sequence: Synthetic polypeptide

SEQ ID NO: 15231 - protein, 32 aa, Artificial Sequence; identical to SEQ ID NO: 1346
  Description of Artificial Sequence: Synthetic polypeptide

SEQ ID NO: 15232 - protein, 32 aa, Artificial Sequence; identical to SEQ ID NO: 1346
  Description of Artificial Sequence: Synthetic polypeptide

SEQ ID NO: 15233 - protein, 32 aa, Artificial Sequence; identical to SEQ ID NO: 1346
  Description of Artificial Sequence: Synthetic polypeptide

SEQ ID NO: 15234 - protein, 32 aa, Artificial Sequence; identical to SEQ ID NO: 1346
  Description of Artificial Sequence: Synthetic polypeptide

SEQ ID NO: 15235 - protein, 32 aa, Artificial Sequence; identical to SEQ ID NO: 1346
  Description of Artificial Sequence: Synthetic polypeptide

SEQ ID NO: 15236 - protein, 32 aa, Artificial Sequence; identical to SEQ ID NO: 1346
  Description of Artificial Sequence: Synthetic polypeptide

SEQ ID NO: 15237 - protein, 32 aa, Artificial Sequence; identical to SEQ ID NO: 1346
  Description of Artificial Sequence: Synthetic polypeptide

SEQ ID NO: 15238 - protein, 32 aa, Artificial Sequence; identical to SEQ ID NO: 12029
  Description of Artificial Sequence: Synthetic polypeptide

SEQ ID NO: 15239 - protein, 32 aa, Artificial Sequence; identical to SEQ ID NO: 1346
  Description of Artificial Sequence: Synthetic polypeptide

SEQ ID NO: 15240 - protein, 32 aa, Artificial Sequence; identical to SEQ ID NO: 1350
  Description of Artificial Sequence: Synthetic polypeptide

SEQ ID NO: 15241 - protein, 32 aa, Artificial Sequence; identical to SEQ ID NO: 1346
  Description of Artificial Sequence: Synthetic polypeptide

SEQ ID NO: 15242 - protein, 32 aa, Artificial Sequence; identical to SEQ ID NO: 1346
  Description of Artificial Sequence: Synthetic polypeptide

SEQ ID NO: 15243 - protein, 32 aa, Artificial Sequence; identical to SEQ ID NO: 1346
  Description of Artificial Sequence: Synthetic polypeptide

SEQ ID NO: 15244 - protein, 32 aa, Artificial Sequence; identical to SEQ ID NO: 1346
  Description of Artificial Sequence: Synthetic polypeptide

SEQ ID NO: 15245 - protein, 32 aa, Artificial Sequence; identical to SEQ ID NO: 1346
  Description of Artificial Sequence: Synthetic polypeptide

SEQ ID NO: 15246 - protein, 32 aa, Artificial Sequence; identical to SEQ ID NO: 1346
  Description of Artificial Sequence: Synthetic polypeptide

SEQ ID NO: 15247 - protein, 32 aa, Artificial Sequence; identical to SEQ ID NO: 1346
  Description of Artificial Sequence: Synthetic polypeptide

SEQ ID NO: 15248 - protein, 32 aa, Artificial Sequence; identical to SEQ ID NO: 1346
  Description of Artificial Sequence: Synthetic polypeptide

SEQ ID NO: 15249 - protein, 32 aa, Artificial Sequence; identical to SEQ ID NO: 1346
  Description of Artificial Sequence: Synthetic polypeptide

SEQ ID NO: 15250 - protein, 32 aa, Artificial Sequence; identical to SEQ ID NO: 1346
  Description of Artificial Sequence: Synthetic polypeptide

SEQ ID NO: 15251 - protein, 32 aa, Artificial Sequence; identical to SEQ ID NO: 1346
  Description of Artificial Sequence: Synthetic polypeptide

SEQ ID NO: 15252 - protein, 32 aa, Artificial Sequence; identical to SEQ ID NO: 1346
  Description of Artificial Sequence: Synthetic polypeptide

SEQ ID NO: 15253 - protein, 32 aa, Artificial Sequence; identical to SEQ ID NO: 1346
  Description of Artificial Sequence: Synthetic polypeptide

SEQ ID NO: 15254 - protein, 32 aa, Artificial Sequence; identical to SEQ ID NO: 1346
  Description of Artificial Sequence: Synthetic polypeptide

SEQ ID NO: 15255 - protein, 32 aa, Artificial Sequence; identical to SEQ ID NO: 1346
  Description of Artificial Sequence: Synthetic polypeptide

SEQ ID NO: 15256 - protein, 32 aa, Artificial Sequence; identical to SEQ ID NO: 1346
  Description of Artificial Sequence: Synthetic polypeptide

SEQ ID NO: 15257 - protein, 32 aa, Artificial Sequence; identical to SEQ ID NO: 4211
  Description of Artificial Sequence: Synthetic polypeptide

SEQ ID NO: 15258 - protein, 32 aa, Artificial Sequence; identical to SEQ ID NO: 1372
  Description of Artificial Sequence: Synthetic polypeptide

SEQ ID NO: 15259 - protein, 32 aa, Artificial Sequence; identical to SEQ ID NO: 1369
  Description of Artificial Sequence: Synthetic polypeptide

SEQ ID NO: 15260 - protein, 32 aa, Artificial Sequence; identical to SEQ ID NO: 1369
  Description of Artificial Sequence: Synthetic polypeptide

SEQ ID NO: 15261 - protein, 32 aa, Artificial Sequence; identical to SEQ ID NO: 1367
  Description of Artificial Sequence: Synthetic polypeptide

SEQ ID NO: 15262 - protein, 32 aa, Artificial Sequence; identical to SEQ ID NO: 1367
  Description of Artificial Sequence: Synthetic polypeptide

SEQ ID NO: 15263 - protein, 32 aa, Artificial Sequence; identical to SEQ ID NO: 1367
  Description of Artificial Sequence: Synthetic polypeptide

SEQ ID NO: 15264 - protein, 32 aa, Artificial Sequence; identical to SEQ ID NO: 1346
  Description of Artificial Sequence: Synthetic polypeptide

SEQ ID NO: 15265 - protein, 32 aa, Artificial Sequence; identical to SEQ ID NO: 1346
  Description of Artificial Sequence: Synthetic polypeptide

SEQ ID NO: 15266 - protein, 32 aa, Artificial Sequence; identical to SEQ ID NO: 12057
  Description of Artificial Sequence: Synthetic polypeptide

SEQ ID NO: 15267 - protein, 32 aa, Artificial Sequence; identical to SEQ ID NO: 12057
  Description of Artificial Sequence: Synthetic polypeptide

SEQ ID NO: 15268 - protein, 32 aa, Artificial Sequence; identical to SEQ ID NO: 12059
  Description of Artificial Sequence: Synthetic polypeptide

SEQ ID NO: 15269 - protein, 32 aa, Artificial Sequence; identical to SEQ ID NO: 12059
  Description of Artificial Sequence: Synthetic polypeptide

SEQ ID NO: 15270 - protein, 32 aa, Artificial Sequence; identical to SEQ ID NO: 12061
  Description of Artificial Sequence: Synthetic polypeptide

SEQ ID NO: 15271 - protein, 32 aa, Artificial Sequence; identical to SEQ ID NO: 12061
  Description of Artificial Sequence: Synthetic polypeptide

SEQ ID NO: 15272 - protein, 32 aa, Artificial Sequence; identical to SEQ ID NO: 12061
  Description of Artificial Sequence: Synthetic polypeptide

SEQ ID NO: 15273 - protein, 32 aa, Artificial Sequence; identical to SEQ ID NO: 12064
  Description of Artificial Sequence: Synthetic polypeptide

SEQ ID NO: 15274 - protein, 32 aa, Artificial Sequence; identical to SEQ ID NO: 12064
  Description of Artificial Sequence: Synthetic polypeptide

SEQ ID NO: 15275 - protein, 32 aa, Artificial Sequence; identical to SEQ ID NO: 12061
  Description of Artificial Sequence: Synthetic polypeptide

SEQ ID NO: 15276 - protein, 32 aa, Artificial Sequence; identical to SEQ ID NO: 12061
  Description of Artificial Sequence: Synthetic polypeptide

SEQ ID NO: 15277 - protein, 32 aa, Artificial Sequence; identical to SEQ ID NO: 1374
  Description of Artificial Sequence: Synthetic polypeptide

SEQ ID NO: 15278 - protein, 32 aa, Artificial Sequence; identical to SEQ ID NO: 1379
  Description of Artificial Sequence: Synthetic polypeptide

SEQ ID NO: 15279 - protein, 32 aa, Artificial Sequence; identical to SEQ ID NO: 12070
  Description of Artificial Sequence: Synthetic polypeptide

SEQ ID NO: 15280 - protein, 32 aa, Artificial Sequence; identical to SEQ ID NO: 1374
  Description of Artificial Sequence: Synthetic polypeptide

SEQ ID NO: 15281 - protein, 32 aa, Artificial Sequence; identical to SEQ ID NO: 12072
  Description of Artificial Sequence: Synthetic polypeptide

SEQ ID NO: 15282 - protein, 32 aa, Artificial Sequence; identical to SEQ ID NO: 12070
  Description of Artificial Sequence: Synthetic polypeptide

SEQ ID NO: 15283 - protein, 32 aa, Artificial Sequence; identical to SEQ ID NO: 1426
  Description of Artificial Sequence: Synthetic polypeptide

SEQ ID NO: 15284 - protein, 32 aa, Artificial Sequence; identical to SEQ ID NO: 1379
  Description of Artificial Sequence: Synthetic polypeptide

SEQ ID NO: 15285 - protein, 32 aa, Artificial Sequence; identical to SEQ ID NO: 1374
  Description of Artificial Sequence: Synthetic polypeptide

SEQ ID NO: 15286 - protein, 32 aa, Artificial Sequence; identical to SEQ ID NO: 1426
  Description of Artificial Sequence: Synthetic polypeptide

SEQ ID NO: 15287 - protein, 32 aa, Artificial Sequence; identical to SEQ ID NO: 12070
  Description of Artificial Sequence: Synthetic polypeptide

SEQ ID NO: 15288 - protein, 32 aa, Artificial Sequence; identical to SEQ ID NO: 1374
  Description of Artificial Sequence: Synthetic polypeptide

SEQ ID NO: 15289 - protein, 32 aa, Artificial Sequence; identical to SEQ ID NO: 12080
  Description of Artificial Sequence: Synthetic polypeptide

SEQ ID NO: 15290 - protein, 32 aa, Artificial Sequence; identical to SEQ ID NO: 1374
  Description of Artificial Sequence: Synthetic polypeptide

SEQ ID NO: 15291 - protein, 32 aa, Artificial Sequence; identical to SEQ ID NO: 1374
  Description of Artificial Sequence: Synthetic polypeptide

SEQ ID NO: 15292 - protein, 32 aa, Artificial Sequence; identical to SEQ ID NO: 1374
  Description of Artificial Sequence: Synthetic polypeptide

SEQ ID NO: 15293 - protein, 32 aa, Artificial Sequence; identical to SEQ ID NO: 1379
  Description of Artificial Sequence: Synthetic polypeptide

SEQ ID NO: 15294 - protein, 32 aa, Artificial Sequence; identical to SEQ ID NO: 12085
  Description of Artificial Sequence: Synthetic polypeptide

SEQ ID NO: 15295 - protein, 32 aa, Artificial Sequence; identical to SEQ ID NO: 1379
  Description of Artificial Sequence: Synthetic polypeptide

SEQ ID NO: 15296 - protein, 32 aa, Artificial Sequence; identical to SEQ ID NO: 12072
  Description of Artificial Sequence: Synthetic polypeptide

SEQ ID NO: 15297 - protein, 32 aa, Artificial Sequence; identical to SEQ ID NO: 1379
  Description of Artificial Sequence: Synthetic polypeptide

SEQ ID NO: 15298 - protein, 32 aa, Artificial Sequence; identical to SEQ ID NO: 1374
  Description of Artificial Sequence: Synthetic polypeptide

SEQ ID NO: 15299 - protein, 32 aa, Artificial Sequence; identical to SEQ ID NO: 12072
  Description of Artificial Sequence: Synthetic polypeptide

SEQ ID NO: 15300 - protein, 32 aa, Artificial Sequence; identical to SEQ ID NO: 1379
  Description of Artificial Sequence: Synthetic polypeptide

SEQ ID NO: 15301 - protein, 32 aa, Artificial Sequence; identical to SEQ ID NO: 1379
  Description of Artificial Sequence: Synthetic polypeptide

SEQ ID NO: 15302 - protein, 32 aa, Artificial Sequence; identical to SEQ ID NO: 1374
  Description of Artificial Sequence: Synthetic polypeptide

SEQ ID NO: 15303 - protein, 32 aa, Artificial Sequence; identical to SEQ ID NO: 1379
  Description of Artificial Sequence: Synthetic polypeptide

SEQ ID NO: 15304 - protein, 32 aa, Artificial Sequence; identical to SEQ ID NO: 1374
  Description of Artificial Sequence: Synthetic polypeptide

SEQ ID NO: 15305 - protein, 32 aa, Artificial Sequence; identical to SEQ ID NO: 1379
  Description of Artificial Sequence: Synthetic polypeptide

SEQ ID NO: 15306 - protein, 32 aa, Artificial Sequence; identical to SEQ ID NO: 1379
  Description of Artificial Sequence: Synthetic polypeptide

SEQ ID NO: 15307 - protein, 32 aa, Artificial Sequence; identical to SEQ ID NO: 1379
  Description of Artificial Sequence: Synthetic polypeptide

SEQ ID NO: 15308 - protein, 32 aa, Artificial Sequence; identical to SEQ ID NO: 1379
  Description of Artificial Sequence: Synthetic polypeptide

SEQ ID NO: 15309 - protein, 32 aa, Artificial Sequence; identical to SEQ ID NO: 1379
  Description of Artificial Sequence: Synthetic polypeptide

SEQ ID NO: 15310 - protein, 32 aa, Artificial Sequence; identical to SEQ ID NO: 1379
  Description of Artificial Sequence: Synthetic polypeptide

SEQ ID NO: 15311 - protein, 32 aa, Artificial Sequence; identical to SEQ ID NO: 12070
  Description of Artificial Sequence: Synthetic polypeptide

SEQ ID NO: 15312 - protein, 32 aa, Artificial Sequence; identical to SEQ ID NO: 1374
  Description of Artificial Sequence: Synthetic polypeptide

SEQ ID NO: 15313 - protein, 32 aa, Artificial Sequence; identical to SEQ ID NO: 1379
  Description of Artificial Sequence: Synthetic polypeptide

SEQ ID NO: 15314 - protein, 32 aa, Artificial Sequence; identical to SEQ ID NO: 12070
  Description of Artificial Sequence: Synthetic polypeptide

SEQ ID NO: 15315 - protein, 32 aa, Artificial Sequence; identical to SEQ ID NO: 12106
  Description of Artificial Sequence: Synthetic polypeptide

SEQ ID NO: 15316 - protein, 32 aa, Artificial Sequence; identical to SEQ ID NO: 12107
  Description of Artificial Sequence: Synthetic polypeptide

SEQ ID NO: 15317 - protein, 32 aa, Artificial Sequence; identical to SEQ ID NO: 1374
  Description of Artificial Sequence: Synthetic polypeptide

SEQ ID NO: 15318 - protein, 32 aa, Artificial Sequence; identical to SEQ ID NO: 1379
  Description of Artificial Sequence: Synthetic polypeptide

SEQ ID NO: 15319 - protein, 32 aa, Artificial Sequence; identical to SEQ ID NO: 1374
  Description of Artificial Sequence: Synthetic polypeptide

SEQ ID NO: 15320 - protein, 32 aa, Artificial Sequence; identical to SEQ ID NO: 12070
  Description of Artificial Sequence: Synthetic polypeptide

SEQ ID NO: 15321 - protein, 32 aa, Artificial Sequence; identical to SEQ ID NO: 1374
  Description of Artificial Sequence: Synthetic polypeptide

SEQ ID NO: 15322 - protein, 32 aa, Artificial Sequence; identical to SEQ ID NO: 1374
  Description of Artificial Sequence: Synthetic polypeptide

SEQ ID NO: 15323 - protein, 32 aa, Artificial Sequence; identical to SEQ ID NO: 12106
  Description of Artificial Sequence: Synthetic polypeptide

SEQ ID NO: 15324 - protein, 32 aa, Artificial Sequence; identical to SEQ ID NO: 1374
  Description of Artificial Sequence: Synthetic polypeptide

SEQ ID NO: 15325 - protein, 32 aa, Artificial Sequence; identical to SEQ ID NO: 12106
  Description of Artificial Sequence: Synthetic polypeptide

SEQ ID NO: 15326 - protein, 32 aa, Artificial Sequence; identical to SEQ ID NO: 1374
  Description of Artificial Sequence: Synthetic polypeptide

SEQ ID NO: 15327 - protein, 32 aa, Artificial Sequence; identical to SEQ ID NO: 1374
  Description of Artificial Sequence: Synthetic polypeptide

SEQ ID NO: 15328 - protein, 32 aa, Artificial Sequence; identical to SEQ ID NO: 1374
  Description of Artificial Sequence: Synthetic polypeptide

SEQ ID NO: 15329 - protein, 32 aa, Artificial Sequence; identical to SEQ ID NO: 1374
  Description of Artificial Sequence: Synthetic polypeptide

SEQ ID NO: 15330 - protein, 32 aa, Artificial Sequence; identical to SEQ ID NO: 12106
  Description of Artificial Sequence: Synthetic polypeptide

SEQ ID NO: 15331 - protein, 32 aa, Artificial Sequence; identical to SEQ ID NO: 12106
  Description of Artificial Sequence: Synthetic polypeptide

SEQ ID NO: 15332 - protein, 32 aa, Artificial Sequence; identical to SEQ ID NO: 1374
  Description of Artificial Sequence: Synthetic polypeptide

SEQ ID NO: 15333 - protein, 32 aa, Artificial Sequence; identical to SEQ ID NO: 1374
  Description of Artificial Sequence: Synthetic polypeptide

SEQ ID NO: 15334 - protein, 32 aa, Artificial Sequence; identical to SEQ ID NO: 1374
  Description of Artificial Sequence: Synthetic polypeptide

SEQ ID NO: 15335 - protein, 32 aa, Artificial Sequence; identical to SEQ ID NO: 1374
  Description of Artificial Sequence: Synthetic polypeptide

SEQ ID NO: 15336 - protein, 32 aa, Artificial Sequence; identical to SEQ ID NO: 1374
  Description of Artificial Sequence: Synthetic polypeptide

SEQ ID NO: 15337 - protein, 32 aa, Artificial Sequence; identical to SEQ ID NO: 1379
  Description of Artificial Sequence: Synthetic polypeptide

SEQ ID NO: 15338 - protein, 32 aa, Artificial Sequence; identical to SEQ ID NO: 1379
  Description of Artificial Sequence: Synthetic polypeptide

SEQ ID NO: 15339 - protein, 32 aa, Artificial Sequence; identical to SEQ ID NO: 12130
  Description of Artificial Sequence: Synthetic polypeptide

SEQ ID NO: 15340 - protein, 32 aa, Artificial Sequence; identical to SEQ ID NO: 4250
  Description of Artificial Sequence: Synthetic polypeptide

SEQ ID NO: 15341 - protein, 32 aa, Artificial Sequence; identical to SEQ ID NO: 4249
  Description of Artificial Sequence: Synthetic polypeptide

SEQ ID NO: 15342 - protein, 32 aa, Artificial Sequence; identical to SEQ ID NO: 4252
  Description of Artificial Sequence: Synthetic polypeptide

SEQ ID NO: 15343 - protein, 32 aa, Artificial Sequence; identical to SEQ ID NO: 4249
  Description of Artificial Sequence: Synthetic polypeptide

SEQ ID NO: 15344 - protein, 32 aa, Artificial Sequence; identical to SEQ ID NO: 4254
  Description of Artificial Sequence: Synthetic polypeptide

SEQ ID NO: 15345 - protein, 32 aa, Artificial Sequence; identical to SEQ ID NO: 4255
  Description of Artificial Sequence: Synthetic polypeptide

SEQ ID NO: 15346 - protein, 32 aa, Artificial Sequence; identical to SEQ ID NO: 4255
  Description of Artificial Sequence: Synthetic polypeptide

SEQ ID NO: 15347 - protein, 32 aa, Artificial Sequence; identical to SEQ ID NO: 4255
  Description of Artificial Sequence: Synthetic polypeptide

SEQ ID NO: 15348 - protein, 32 aa, Artificial Sequence; identical to SEQ ID NO: 4255
  Description of Artificial Sequence: Synthetic polypeptide

SEQ ID NO: 15349 - protein, 32 aa, Artificial Sequence; identical to SEQ ID NO: 4255
  Description of Artificial Sequence: Synthetic polypeptide

SEQ ID NO: 15350 - protein, 32 aa, Artificial Sequence; identical to SEQ ID NO: 4255
  Description of Artificial Sequence: Synthetic polypeptide

SEQ ID NO: 15351 - protein, 32 aa, Artificial Sequence; identical to SEQ ID NO: 4255
  Description of Artificial Sequence: Synthetic polypeptide

SEQ ID NO: 15352 - protein, 32 aa, Artificial Sequence; identical to SEQ ID NO: 1499
  Description of Artificial Sequence: Synthetic polypeptide

SEQ ID NO: 15353 - protein, 32 aa, Artificial Sequence; identical to SEQ ID NO: 12144
  Description of Artificial Sequence: Synthetic polypeptide

SEQ ID NO: 15354 - protein, 32 aa, Artificial Sequence; identical to SEQ ID NO: 12145
  Description of Artificial Sequence: Synthetic polypeptide

SEQ ID NO: 15355 - protein, 32 aa, Artificial Sequence; identical to SEQ ID NO: 5726
  Description of Artificial Sequence: Synthetic polypeptide

SEQ ID NO: 15356 - protein, 32 aa, Artificial Sequence; identical to SEQ ID NO: 12147
  Description of Artificial Sequence: Synthetic polypeptide

SEQ ID NO: 15357 - protein, 32 aa, Artificial Sequence; identical to SEQ ID NO: 5726
  Description of Artificial Sequence: Synthetic polypeptide

SEQ ID NO: 15358 - protein, 32 aa, Artificial Sequence; identical to SEQ ID NO: 12144
  Description of Artificial Sequence: Synthetic polypeptide

SEQ ID NO: 15359 - protein, 32 aa, Artificial Sequence; identical to SEQ ID NO: 5726
  Description of Artificial Sequence: Synthetic polypeptide

SEQ ID NO: 15360 - protein, 32 aa, Artificial Sequence; identical to SEQ ID NO: 12151
  Description of Artificial Sequence: Synthetic polypeptide

SEQ ID NO: 15361 - protein, 32 aa, Artificial Sequence; identical to SEQ ID NO: 12145
  Description of Artificial Sequence: Synthetic polypeptide

SEQ ID NO: 15362 - protein, 32 aa, Artificial Sequence; identical to SEQ ID NO: 5726
  Description of Artificial Sequence: Synthetic polypeptide

SEQ ID NO: 15363 - protein, 32 aa, Artificial Sequence; identical to SEQ ID NO: 1427
  Description of Artificial Sequence: Synthetic polypeptide

SEQ ID NO: 15364 - protein, 32 aa, Artificial Sequence; identical to SEQ ID NO: 1427
  Description of Artificial Sequence: Synthetic polypeptide

SEQ ID NO: 15365 - protein, 32 aa, Artificial Sequence; identical to SEQ ID NO: 1427
  Description of Artificial Sequence: Synthetic polypeptide

SEQ ID NO: 15366 - protein, 32 aa, Artificial Sequence; identical to SEQ ID NO: 1427
  Description of Artificial Sequence: Synthetic polypeptide

SEQ ID NO: 15367 - protein, 32 aa, Artificial Sequence; identical to SEQ ID NO: 1427
  Description of Artificial Sequence: Synthetic polypeptide

SEQ ID NO: 15368 - protein, 32 aa, Artificial Sequence; identical to SEQ ID NO: 1427
  Description of Artificial Sequence: Synthetic polypeptide

SEQ ID NO: 15369 - protein, 32 aa, Artificial Sequence; identical to SEQ ID NO: 1501
  Description of Artificial Sequence: Synthetic polypeptide

SEQ ID NO: 15370 - protein, 32 aa, Artificial Sequence; identical to SEQ ID NO: 1501
  Description of Artificial Sequence: Synthetic polypeptide

SEQ ID NO: 15371 - protein, 32 aa, Artificial Sequence; identical to SEQ ID NO: 12162
  Description of Artificial Sequence: Synthetic polypeptide

SEQ ID NO: 15372 - protein, 32 aa, Artificial Sequence; identical to SEQ ID NO: 1499
  Description of Artificial Sequence: Synthetic polypeptide

SEQ ID NO: 15373 - protein, 32 aa, Artificial Sequence; identical to SEQ ID NO: 1499
  Description of Artificial Sequence: Synthetic polypeptide

SEQ ID NO: 15374 - protein, 32 aa, Artificial Sequence; identical to SEQ ID NO: 1499
  Description of Artificial Sequence: Synthetic polypeptide

SEQ ID NO: 15375 - protein, 32 aa, Artificial Sequence; identical to SEQ ID NO: 5726
  Description of Artificial Sequence: Synthetic polypeptide

SEQ ID NO: 15376 - protein, 32 aa, Artificial Sequence; identical to SEQ ID NO: 1499
  Description of Artificial Sequence: Synthetic polypeptide

SEQ ID NO: 15377 - protein, 32 aa, Artificial Sequence; identical to SEQ ID NO: 1499
  Description of Artificial Sequence: Synthetic polypeptide

SEQ ID NO: 15378 - protein, 32 aa, Artificial Sequence; identical to SEQ ID NO: 12169
  Description of Artificial Sequence: Synthetic polypeptide

SEQ ID NO: 15379 - protein, 32 aa, Artificial Sequence; identical to SEQ ID NO: 1499
  Description of Artificial Sequence: Synthetic polypeptide

SEQ ID NO: 15380 - protein, 32 aa, Artificial Sequence; identical to SEQ ID NO: 1499
  Description of Artificial Sequence: Synthetic polypeptide

SEQ ID NO: 15381 - protein, 32 aa, Artificial Sequence; identical to SEQ ID NO: 1499
  Description of Artificial Sequence: Synthetic polypeptide

SEQ ID NO: 15382 - protein, 32 aa, Artificial Sequence; identical to SEQ ID NO: 1427
  Description of Artificial Sequence: Synthetic polypeptide

SEQ ID NO: 15383 - protein, 32 aa, Artificial Sequence; identical to SEQ ID NO: 1427
  Description of Artificial Sequence: Synthetic polypeptide

SEQ ID NO: 15384 - protein, 32 aa, Artificial Sequence; identical to SEQ ID NO: 12175
  Description of Artificial Sequence: Synthetic polypeptide

SEQ ID NO: 15385 - protein, 32 aa, Artificial Sequence; identical to SEQ ID NO: 1427
  Description of Artificial Sequence: Synthetic polypeptide

SEQ ID NO: 15386 - protein, 32 aa, Artificial Sequence; identical to SEQ ID NO: 1427
  Description of Artificial Sequence: Synthetic polypeptide

SEQ ID NO: 15387 - protein, 32 aa, Artificial Sequence; identical to SEQ ID NO: 1427
  Description of Artificial Sequence: Synthetic polypeptide

SEQ ID NO: 15388 - protein, 32 aa, Artificial Sequence; identical to SEQ ID NO: 1427
  Description of Artificial Sequence: Synthetic polypeptide

SEQ ID NO: 15389 - protein, 32 aa, Artificial Sequence; identical to SEQ ID NO: 1427
  Description of Artificial Sequence: Synthetic polypeptide

SEQ ID NO: 15390 - protein, 32 aa, Artificial Sequence; identical to SEQ ID NO: 1427
  Description of Artificial Sequence: Synthetic polypeptide

SEQ ID NO: 15391 - protein, 32 aa, Artificial Sequence; identical to SEQ ID NO: 1427
  Description of Artificial Sequence: Synthetic polypeptide

SEQ ID NO: 15392 - protein, 32 aa, Artificial Sequence; identical to SEQ ID NO: 12183
  Description of Artificial Sequence: Synthetic polypeptide

SEQ ID NO: 15393 - protein, 32 aa, Artificial Sequence; identical to SEQ ID NO: 12183
  Description of Artificial Sequence: Synthetic polypeptide

SEQ ID NO: 15394 - protein, 32 aa, Artificial Sequence; identical to SEQ ID NO: 1427
  Description of Artificial Sequence: Synthetic polypeptide

SEQ ID NO: 15395 - protein, 32 aa, Artificial Sequence; identical to SEQ ID NO: 1499
  Description of Artificial Sequence: Synthetic polypeptide

SEQ ID NO: 15396 - protein, 32 aa, Artificial Sequence; identical to SEQ ID NO: 1499
  Description of Artificial Sequence: Synthetic polypeptide

SEQ ID NO: 15397 - protein, 32 aa, Artificial Sequence; identical to SEQ ID NO: 12188
  Description of Artificial Sequence: Synthetic polypeptide

SEQ ID NO: 15398 - protein, 32 aa, Artificial Sequence; identical to SEQ ID NO: 12189
  Description of Artificial Sequence: Synthetic polypeptide

SEQ ID NO: 15399 - protein, 32 aa, Artificial Sequence; identical to SEQ ID NO: 12189
  Description of Artificial Sequence: Synthetic polypeptide

SEQ ID NO: 15400 - protein, 32 aa, Artificial Sequence; identical to SEQ ID NO: 12191
  Description of Artificial Sequence: Synthetic polypeptide

SEQ ID NO: 15401 - protein, 32 aa, Artificial Sequence; identical to SEQ ID NO: 12191
  Description of Artificial Sequence: Synthetic polypeptide

SEQ ID NO: 15402 - protein, 32 aa, Artificial Sequence; identical to SEQ ID NO: 12191
  Description of Artificial Sequence: Synthetic polypeptide

SEQ ID NO: 15403 - protein, 32 aa, Artificial Sequence; identical to SEQ ID NO: 12194
  Description of Artificial Sequence: Synthetic polypeptide

SEQ ID NO: 15404 - protein, 32 aa, Artificial Sequence; identical to SEQ ID NO: 12189
  Description of Artificial Sequence: Synthetic polypeptide

SEQ ID NO: 15405 - protein, 32 aa, Artificial Sequence; identical to SEQ ID NO: 12191
  Description of Artificial Sequence: Synthetic polypeptide

SEQ ID NO: 15406 - protein, 32 aa, Artificial Sequence; identical to SEQ ID NO: 12191
  Description of Artificial Sequence: Synthetic polypeptide

SEQ ID NO: 15407 - protein, 32 aa, Artificial Sequence; identical to SEQ ID NO: 12198
  Description of Artificial Sequence: Synthetic polypeptide

SEQ ID NO: 15408 - protein, 32 aa, Artificial Sequence; identical to SEQ ID NO: 12199
  Description of Artificial Sequence: Synthetic polypeptide

SEQ ID NO: 15409 - protein, 32 aa, Artificial Sequence; identical to SEQ ID NO: 12189
  Description of Artificial Sequence: Synthetic polypeptide

SEQ ID NO: 15410 - protein, 32 aa, Artificial Sequence; identical to SEQ ID NO: 12189
  Description of Artificial Sequence: Synthetic polypeptide

SEQ ID NO: 15411 - protein, 32 aa, Artificial Sequence; identical to SEQ ID NO: 12189
  Description of Artificial Sequence: Synthetic polypeptide

SEQ ID NO: 15412 - protein, 32 aa, Artificial Sequence; identical to SEQ ID NO: 12189
  Description of Artificial Sequence: Synthetic polypeptide

SEQ ID NO: 15413 - protein, 32 aa, Artificial Sequence; identical to SEQ ID NO: 12189
  Description of Artificial Sequence: Synthetic polypeptide

SEQ ID NO: 15414 - protein, 32 aa, Artificial Sequence; identical to SEQ ID NO: 1427
  Description of Artificial Sequence: Synthetic polypeptide

SEQ ID NO: 15415 - protein, 32 aa, Artificial Sequence; identical to SEQ ID NO: 5703
  Description of Artificial Sequence: Synthetic polypeptide

SEQ ID NO: 15416 - protein, 32 aa, Artificial Sequence; identical to SEQ ID NO: 1501
  Description of Artificial Sequence: Synthetic polypeptide

SEQ ID NO: 15417 - protein, 32 aa, Artificial Sequence; identical to SEQ ID NO: 1501
  Description of Artificial Sequence: Synthetic polypeptide

SEQ ID NO: 15418 - protein, 32 aa, Artificial Sequence; identical to SEQ ID NO: 1501
  Description of Artificial Sequence: Synthetic polypeptide

SEQ ID NO: 15419 - protein, 32 aa, Artificial Sequence; identical to SEQ ID NO: 4255
  Description of Artificial Sequence: Synthetic polypeptide

SEQ ID NO: 15420 - protein, 32 aa, Artificial Sequence; identical to SEQ ID NO: 12211
  Description of Artificial Sequence: Synthetic polypeptide

SEQ ID NO: 15421 - protein, 32 aa, Artificial Sequence; identical to SEQ ID NO: 4255
  Description of Artificial Sequence: Synthetic polypeptide

SEQ ID NO: 15422 - protein, 32 aa, Artificial Sequence; identical to SEQ ID NO: 12213
  Description of Artificial Sequence: Synthetic polypeptide

SEQ ID NO: 15423 - protein, 32 aa, Artificial Sequence; identical to SEQ ID NO: 12214
  Description of Artificial Sequence: Synthetic polypeptide

SEQ ID NO: 15424 - protein, 32 aa, Artificial Sequence; identical to SEQ ID NO: 12215
  Description of Artificial Sequence: Synthetic polypeptide

SEQ ID NO: 15425 - protein, 32 aa, Artificial Sequence; identical to SEQ ID NO: 1504
  Description of Artificial Sequence: Synthetic polypeptide

SEQ ID NO: 15426 - protein, 32 aa, Artificial Sequence; identical to SEQ ID NO: 12217
  Description of Artificial Sequence: Synthetic polypeptide

SEQ ID NO: 15427 - protein, 32 aa, Artificial Sequence; identical to SEQ ID NO: 1501
  Description of Artificial Sequence: Synthetic polypeptide

SEQ ID NO: 15428 - protein, 32 aa, Artificial Sequence; identical to SEQ ID NO: 1501
  Description of Artificial Sequence: Synthetic polypeptide

SEQ ID NO: 15429 - protein, 32 aa, Artificial Sequence; identical to SEQ ID NO: 1501
  Description of Artificial Sequence: Synthetic polypeptide

SEQ ID NO: 15430 - protein, 32 aa, Artificial Sequence; identical to SEQ ID NO: 1499
  Description of Artificial Sequence: Synthetic polypeptide

SEQ ID NO: 15431 - protein, 32 aa, Artificial Sequence; identical to SEQ ID NO: 1499
  Description of Artificial Sequence: Synthetic polypeptide

SEQ ID NO: 15432 - protein, 32 aa, Artificial Sequence; identical to SEQ ID NO: 1499
  Description of Artificial Sequence: Synthetic polypeptide

SEQ ID NO: 15433 - protein, 32 aa, Artificial Sequence; identical to SEQ ID NO: 1499
  Description of Artificial Sequence: Synthetic polypeptide

SEQ ID NO: 15434 - protein, 32 aa, Artificial Sequence; identical to SEQ ID NO: 1499
  Description of Artificial Sequence: Synthetic polypeptide

SEQ ID NO: 15435 - protein, 32 aa, Artificial Sequence; identical to SEQ ID NO: 5722
  Description of Artificial Sequence: Synthetic polypeptide

SEQ ID NO: 15436 - protein, 32 aa, Artificial Sequence; identical to SEQ ID NO: 5722
  Description of Artificial Sequence: Synthetic polypeptide

SEQ ID NO: 15437 - protein, 32 aa, Artificial Sequence; identical to SEQ ID NO: 1499
  Description of Artificial Sequence: Synthetic polypeptide

SEQ ID NO: 15438 - protein, 32 aa, Artificial Sequence; identical to SEQ ID NO: 12229
  Description of Artificial Sequence: Synthetic polypeptide

SEQ ID NO: 15439 - protein, 32 aa, Artificial Sequence; identical to SEQ ID NO: 1478
  Description of Artificial Sequence: Synthetic polypeptide

SEQ ID NO: 15440 - protein, 32 aa, Artificial Sequence; identical to SEQ ID NO: 12231
  Description of Artificial Sequence: Synthetic polypeptide

SEQ ID NO: 15441 - protein, 32 aa, Artificial Sequence; identical to SEQ ID NO: 12232
  Description of Artificial Sequence: Synthetic polypeptide

SEQ ID NO: 15442 - protein, 32 aa, Artificial Sequence; identical to SEQ ID NO: 1479
  Description of Artificial Sequence: Synthetic polypeptide

SEQ ID NO: 15443 - protein, 32 aa, Artificial Sequence; identical to SEQ ID NO: 1427
  Description of Artificial Sequence: Synthetic polypeptide

SEQ ID NO: 15444 - protein, 32 aa, Artificial Sequence; identical to SEQ ID NO: 1427
  Description of Artificial Sequence: Synthetic polypeptide

SEQ ID NO: 15445 - protein, 32 aa, Artificial Sequence; identical to SEQ ID NO: 1499
  Description of Artificial Sequence: Synthetic polypeptide

SEQ ID NO: 15446 - protein, 32 aa, Artificial Sequence; identical to SEQ ID NO: 12237
  Description of Artificial Sequence: Synthetic polypeptide

SEQ ID NO: 15447 - protein, 32 aa, Artificial Sequence; identical to SEQ ID NO: 1490
  Description of Artificial Sequence: Synthetic polypeptide

SEQ ID NO: 15448 - protein, 32 aa, Artificial Sequence; identical to SEQ ID NO: 1479
  Description of Artificial Sequence: Synthetic polypeptide

SEQ ID NO: 15449 - protein, 32 aa, Artificial Sequence; identical to SEQ ID NO: 1479
  Description of Artificial Sequence: Synthetic polypeptide

SEQ ID NO: 15450 - protein, 32 aa, Artificial Sequence; identical to SEQ ID NO: 1479
  Description of Artificial Sequence: Synthetic polypeptide

SEQ ID NO: 15451 - protein, 32 aa, Artificial Sequence; identical to SEQ ID NO: 1479
  Description of Artificial Sequence: Synthetic polypeptide

SEQ ID NO: 15452 - protein, 32 aa, Artificial Sequence; identical to SEQ ID NO: 1479
  Description of Artificial Sequence: Synthetic polypeptide

SEQ ID NO: 15453 - protein, 32 aa, Artificial Sequence; identical to SEQ ID NO: 1479
  Description of Artificial Sequence: Synthetic polypeptide

SEQ ID NO: 15454 - protein, 32 aa, Artificial Sequence; identical to SEQ ID NO: 1479
  Description of Artificial Sequence: Synthetic polypeptide

SEQ ID NO: 15455 - protein, 32 aa, Artificial Sequence; identical to SEQ ID NO: 1479
  Description of Artificial Sequence: Synthetic polypeptide

SEQ ID NO: 15456 - protein, 32 aa, Artificial Sequence; identical to SEQ ID NO: 1479
  Description of Artificial Sequence: Synthetic polypeptide

SEQ ID NO: 15457 - protein, 32 aa, Artificial Sequence; identical to SEQ ID NO: 1479
  Description of Artificial Sequence: Synthetic polypeptide

SEQ ID NO: 15458 - protein, 32 aa, Artificial Sequence; identical to SEQ ID NO: 1427
  Description of Artificial Sequence: Synthetic polypeptide

SEQ ID NO: 15459 - protein, 32 aa, Artificial Sequence; identical to SEQ ID NO: 1427
  Description of Artificial Sequence: Synthetic polypeptide

SEQ ID NO: 15460 - protein, 32 aa, Artificial Sequence; identical to SEQ ID NO: 1427
  Description of Artificial Sequence: Synthetic polypeptide

SEQ ID NO: 15461 - protein, 32 aa, Artificial Sequence; identical to SEQ ID NO: 1499
  Description of Artificial Sequence: Synthetic polypeptide

SEQ ID NO: 15462 - protein, 32 aa, Artificial Sequence; identical to SEQ ID NO: 12253
  Description of Artificial Sequence: Synthetic polypeptide

SEQ ID NO: 15463 - protein, 32 aa, Artificial Sequence; identical to SEQ ID NO: 12189
  Description of Artificial Sequence: Synthetic polypeptide

SEQ ID NO: 15464 - protein, 32 aa, Artificial Sequence; identical to SEQ ID NO: 12189
  Description of Artificial Sequence: Synthetic polypeptide

SEQ ID NO: 15465 - protein, 32 aa, Artificial Sequence; identical to SEQ ID NO: 1507
  Description of Artificial Sequence: Synthetic polypeptide

SEQ ID NO: 15466 - protein, 32 aa, Artificial Sequence; identical to SEQ ID NO: 12189
  Description of Artificial Sequence: Synthetic polypeptide

SEQ ID NO: 15467 - protein, 32 aa, Artificial Sequence; identical to SEQ ID NO: 1507
  Description of Artificial Sequence: Synthetic polypeptide

SEQ ID NO: 15468 - protein, 32 aa, Artificial Sequence; identical to SEQ ID NO: 1480
  Description of Artificial Sequence: Synthetic polypeptide

SEQ ID NO: 15469 - protein, 32 aa, Artificial Sequence; identical to SEQ ID NO: 1481
  Description of Artificial Sequence: Synthetic polypeptide

SEQ ID NO: 15470 - protein, 32 aa, Artificial Sequence; identical to SEQ ID NO: 1481
  Description of Artificial Sequence: Synthetic polypeptide

SEQ ID NO: 15471 - protein, 32 aa, Artificial Sequence; identical to SEQ ID NO: 1481
  Description of Artificial Sequence: Synthetic polypeptide

SEQ ID NO: 15472 - protein, 32 aa, Artificial Sequence; identical to SEQ ID NO: 1481
  Description of Artificial Sequence: Synthetic polypeptide

SEQ ID NO: 15473 - protein, 32 aa, Artificial Sequence; identical to SEQ ID NO: 1481
  Description of Artificial Sequence: Synthetic polypeptide

SEQ ID NO: 15474 - protein, 32 aa, Artificial Sequence; identical to SEQ ID NO: 1481
  Description of Artificial Sequence: Synthetic polypeptide

SEQ ID NO: 15475 - protein, 32 aa, Artificial Sequence; identical to SEQ ID NO: 1480
  Description of Artificial Sequence: Synthetic polypeptide

SEQ ID NO: 15476 - protein, 32 aa, Artificial Sequence; identical to SEQ ID NO: 1480
  Description of Artificial Sequence: Synthetic polypeptide

SEQ ID NO: 15477 - protein, 32 aa, Artificial Sequence; identical to SEQ ID NO: 1481
  Description of Artificial Sequence: Synthetic polypeptide

SEQ ID NO: 15478 - protein, 32 aa, Artificial Sequence; identical to SEQ ID NO: 1481
  Description of Artificial Sequence: Synthetic polypeptide

SEQ ID NO: 15479 - protein, 32 aa, Artificial Sequence; identical to SEQ ID NO: 1481
  Description of Artificial Sequence: Synthetic polypeptide

SEQ ID NO: 15480 - protein, 32 aa, Artificial Sequence; identical to SEQ ID NO: 1481
  Description of Artificial Sequence: Synthetic polypeptide

SEQ ID NO: 15481 - protein, 32 aa, Artificial Sequence; identical to SEQ ID NO: 1481
  Description of Artificial Sequence: Synthetic polypeptide

SEQ ID NO: 15482 - protein, 32 aa, Artificial Sequence; identical to SEQ ID NO: 1481
  Description of Artificial Sequence: Synthetic polypeptide

SEQ ID NO: 15483 - protein, 32 aa, Artificial Sequence; identical to SEQ ID NO: 1481
  Description of Artificial Sequence: Synthetic polypeptide

SEQ ID NO: 15484 - protein, 32 aa, Artificial Sequence; identical to SEQ ID NO: 1480
  Description of Artificial Sequence: Synthetic polypeptide

SEQ ID NO: 15485 - protein, 32 aa, Artificial Sequence; identical to SEQ ID NO: 1481
  Description of Artificial Sequence: Synthetic polypeptide

SEQ ID NO: 15486 - protein, 32 aa, Artificial Sequence; identical to SEQ ID NO: 1481
  Description of Artificial Sequence: Synthetic polypeptide

SEQ ID NO: 15487 - protein, 32 aa, Artificial Sequence; identical to SEQ ID NO: 1480
  Description of Artificial Sequence: Synthetic polypeptide

SEQ ID NO: 15488 - protein, 32 aa, Artificial Sequence; identical to SEQ ID NO: 1481
  Description of Artificial Sequence: Synthetic polypeptide

SEQ ID NO: 15489 - protein, 32 aa, Artificial Sequence; identical to SEQ ID NO: 1480
  Description of Artificial Sequence: Synthetic polypeptide

SEQ ID NO: 15490 - protein, 32 aa, Artificial Sequence; identical to SEQ ID NO: 1480
  Description of Artificial Sequence: Synthetic polypeptide

SEQ ID NO: 15491 - protein, 32 aa, Artificial Sequence; identical to SEQ ID NO: 1480
  Description of Artificial Sequence: Synthetic polypeptide

SEQ ID NO: 15492 - protein, 32 aa, Artificial Sequence; identical to SEQ ID NO: 1499
  Description of Artificial Sequence: Synthetic polypeptide

SEQ ID NO: 15493 - protein, 32 aa, Artificial Sequence; identical to SEQ ID NO: 12284
  Description of Artificial Sequence: Synthetic polypeptide

SEQ ID NO: 15494 - protein, 32 aa, Artificial Sequence; identical to SEQ ID NO: 1507
  Description of Artificial Sequence: Synthetic polypeptide

SEQ ID NO: 15495 - protein, 32 aa, Artificial Sequence; identical to SEQ ID NO: 1507
  Description of Artificial Sequence: Synthetic polypeptide

SEQ ID NO: 15496 - protein, 32 aa, Artificial Sequence; identical to SEQ ID NO: 1427
  Description of Artificial Sequence: Synthetic polypeptide

SEQ ID NO: 15497 - protein, 32 aa, Artificial Sequence; identical to SEQ ID NO: 1428
  Description of Artificial Sequence: Synthetic polypeptide

SEQ ID NO: 15498 - protein, 32 aa, Artificial Sequence; identical to SEQ ID NO: 1428
  Description of Artificial Sequence: Synthetic polypeptide

SEQ ID NO: 15499 - protein, 32 aa, Artificial Sequence; identical to SEQ ID NO: 1428
  Description of Artificial Sequence: Synthetic polypeptide

SEQ ID NO: 15500 - protein, 32 aa, Artificial Sequence; identical to SEQ ID NO: 1428
  Description of Artificial Sequence: Synthetic polypeptide

SEQ ID NO: 15501 - protein, 32 aa, Artificial Sequence; identical to SEQ ID NO: 1432
  Description of Artificial Sequence: Synthetic polypeptide

SEQ ID NO: 15502 - protein, 32 aa, Artificial Sequence; identical to SEQ ID NO: 1428
  Description of Artificial Sequence: Synthetic polypeptide

SEQ ID NO: 15503 - protein, 32 aa, Artificial Sequence; identical to SEQ ID NO: 1428
  Description of Artificial Sequence: Synthetic polypeptide

SEQ ID NO: 15504 - protein, 32 aa, Artificial Sequence; identical to SEQ ID NO: 1428
  Description of Artificial Sequence: Synthetic polypeptide

SEQ ID NO: 15505 - protein, 32 aa, Artificial Sequence; identical to SEQ ID NO: 1428
  Description of Artificial Sequence: Synthetic polypeptide

SEQ ID NO: 15506 - protein, 32 aa, Artificial Sequence; identical to SEQ ID NO: 1428
  Description of Artificial Sequence: Synthetic polypeptide

SEQ ID NO: 15507 - protein, 32 aa, Artificial Sequence; identical to SEQ ID NO: 1428
  Description of Artificial Sequence: Synthetic polypeptide

SEQ ID NO: 15508 - protein, 32 aa, Artificial Sequence; identical to SEQ ID NO: 1428
  Description of Artificial Sequence: Synthetic polypeptide

SEQ ID NO: 15509 - protein, 32 aa, Artificial Sequence; identical to SEQ ID NO: 1428
  Description of Artificial Sequence: Synthetic polypeptide

SEQ ID NO: 15510 - protein, 32 aa, Artificial Sequence; identical to SEQ ID NO: 1428
  Description of Artificial Sequence: Synthetic polypeptide

SEQ ID NO: 15511 - protein, 32 aa, Artificial Sequence; identical to SEQ ID NO: 1428
  Description of Artificial Sequence: Synthetic polypeptide

SEQ ID NO: 15512 - protein, 32 aa, Artificial Sequence; identical to SEQ ID NO: 1428
  Description of Artificial Sequence: Synthetic polypeptide

SEQ ID NO: 15513 - protein, 32 aa, Artificial Sequence; identical to SEQ ID NO: 12304
  Description of Artificial Sequence: Synthetic polypeptide

SEQ ID NO: 15514 - protein, 32 aa, Artificial Sequence; identical to SEQ ID NO: 1428
  Description of Artificial Sequence: Synthetic polypeptide

SEQ ID NO: 15515 - protein, 32 aa, Artificial Sequence; identical to SEQ ID NO: 1428
  Description of Artificial Sequence: Synthetic polypeptide

SEQ ID NO: 15516 - protein, 32 aa, Artificial Sequence; identical to SEQ ID NO: 1428
  Description of Artificial Sequence: Synthetic polypeptide

SEQ ID NO: 15517 - protein, 32 aa, Artificial Sequence; identical to SEQ ID NO: 1428
  Description of Artificial Sequence: Synthetic polypeptide

SEQ ID NO: 15518 - protein, 32 aa, Artificial Sequence; identical to SEQ ID NO: 1428
  Description of Artificial Sequence: Synthetic polypeptide

SEQ ID NO: 15519 - protein, 32 aa, Artificial Sequence; identical to SEQ ID NO: 1434
  Description of Artificial Sequence: Synthetic polypeptide

SEQ ID NO: 15520 - protein, 32 aa, Artificial Sequence; identical to SEQ ID NO: 1428
  Description of Artificial Sequence: Synthetic polypeptide

SEQ ID NO: 15521 - protein, 32 aa, Artificial Sequence; identical to SEQ ID NO: 1428
  Description of Artificial Sequence: Synthetic polypeptide

SEQ ID NO: 15522 - protein, 32 aa, Artificial Sequence; identical to SEQ ID NO: 1428
  Description of Artificial Sequence: Synthetic polypeptide

SEQ ID NO: 15523 - protein, 32 aa, Artificial Sequence; identical to SEQ ID NO: 1428
  Description of Artificial Sequence: Synthetic polypeptide

SEQ ID NO: 15524 - protein, 32 aa, Artificial Sequence; identical to SEQ ID NO: 1428
  Description of Artificial Sequence: Synthetic polypeptide

SEQ ID NO: 15525 - protein, 32 aa, Artificial Sequence; identical to SEQ ID NO: 1434
  Description of Artificial Sequence: Synthetic polypeptide

SEQ ID NO: 15526 - protein, 32 aa, Artificial Sequence; identical to SEQ ID NO: 1432
  Description of Artificial Sequence: Synthetic polypeptide

SEQ ID NO: 15527 - protein, 32 aa, Artificial Sequence; identical to SEQ ID NO: 1428
  Description of Artificial Sequence: Synthetic polypeptide

SEQ ID NO: 15528 - protein, 32 aa, Artificial Sequence; identical to SEQ ID NO: 1428
  Description of Artificial Sequence: Synthetic polypeptide

SEQ ID NO: 15529 - protein, 32 aa, Artificial Sequence; identical to SEQ ID NO: 1432
  Description of Artificial Sequence: Synthetic polypeptide

SEQ ID NO: 15530 - protein, 32 aa, Artificial Sequence; identical to SEQ ID NO: 1428
  Description of Artificial Sequence: Synthetic polypeptide

SEQ ID NO: 15531 - protein, 32 aa, Artificial Sequence; identical to SEQ ID NO: 1428
  Description of Artificial Sequence: Synthetic polypeptide

SEQ ID NO: 15532 - protein, 32 aa, Artificial Sequence; identical to SEQ ID NO: 1428
  Description of Artificial Sequence: Synthetic polypeptide

SEQ ID NO: 15533 - protein, 32 aa, Artificial Sequence; identical to SEQ ID NO: 1432
  Description of Artificial Sequence: Synthetic polypeptide

SEQ ID NO: 15534 - protein, 32 aa, Artificial Sequence; identical to SEQ ID NO: 1432
  Description of Artificial Sequence: Synthetic polypeptide

SEQ ID NO: 15535 - protein, 32 aa, Artificial Sequence; identical to SEQ ID NO: 1428
  Description of Artificial Sequence: Synthetic polypeptide

SEQ ID NO: 15536 - protein, 32 aa, Artificial Sequence; identical to SEQ ID NO: 1428
  Description of Artificial Sequence: Synthetic polypeptide

SEQ ID NO: 15537 - protein, 32 aa, Artificial Sequence; identical to SEQ ID NO: 1428
  Description of Artificial Sequence: Synthetic polypeptide

SEQ ID NO: 15538 - protein, 32 aa, Artificial Sequence; identical to SEQ ID NO: 1434
  Description of Artificial Sequence: Synthetic polypeptide

SEQ ID NO: 15539 - protein, 32 aa, Artificial Sequence; identical to SEQ ID NO: 1428
  Description of Artificial Sequence: Synthetic polypeptide

SEQ ID NO: 15540 - protein, 32 aa, Artificial Sequence; identical to SEQ ID NO: 1428
  Description of Artificial Sequence: Synthetic polypeptide

SEQ ID NO: 15541 - protein, 32 aa, Artificial Sequence; identical to SEQ ID NO: 1432
  Description of Artificial Sequence: Synthetic polypeptide

SEQ ID NO: 15542 - protein, 32 aa, Artificial Sequence; identical to SEQ ID NO: 12333
  Description of Artificial Sequence: Synthetic polypeptide

SEQ ID NO: 15543 - protein, 32 aa, Artificial Sequence; identical to SEQ ID NO: 1434
  Description of Artificial Sequence: Synthetic polypeptide

SEQ ID NO: 15544 - protein, 32 aa, Artificial Sequence; identical to SEQ ID NO: 1428
  Description of Artificial Sequence: Synthetic polypeptide

SEQ ID NO: 15545 - protein, 32 aa, Artificial Sequence; identical to SEQ ID NO: 1428
  Description of Artificial Sequence: Synthetic polypeptide

SEQ ID NO: 15546 - protein, 32 aa, Artificial Sequence; identical to SEQ ID NO: 1428
  Description of Artificial Sequence: Synthetic polypeptide

SEQ ID NO: 15547 - protein, 32 aa, Artificial Sequence; identical to SEQ ID NO: 1432
  Description of Artificial Sequence: Synthetic polypeptide

SEQ ID NO: 15548 - protein, 32 aa, Artificial Sequence; identical to SEQ ID NO: 12333
  Description of Artificial Sequence: Synthetic polypeptide

SEQ ID NO: 15549 - protein, 32 aa, Artificial Sequence; identical to SEQ ID NO: 12333
  Description of Artificial Sequence: Synthetic polypeptide

SEQ ID NO: 15550 - protein, 32 aa, Artificial Sequence; identical to SEQ ID NO: 1434
  Description of Artificial Sequence: Synthetic polypeptide

SEQ ID NO: 15551 - protein, 32 aa, Artificial Sequence; identical to SEQ ID NO: 1434
  Description of Artificial Sequence: Synthetic polypeptide

SEQ ID NO: 15552 - protein, 32 aa, Artificial Sequence; identical to SEQ ID NO: 1428
  Description of Artificial Sequence: Synthetic polypeptide

SEQ ID NO: 15553 - protein, 32 aa, Artificial Sequence; identical to SEQ ID NO: 1428
  Description of Artificial Sequence: Synthetic polypeptide

SEQ ID NO: 15554 - protein, 32 aa, Artificial Sequence; identical to SEQ ID NO: 1427
  Description of Artificial Sequence: Synthetic polypeptide

SEQ ID NO: 15555 - protein, 32 aa, Artificial Sequence; identical to SEQ ID NO: 1428
  Description of Artificial Sequence: Synthetic polypeptide

SEQ ID NO: 15556 - protein, 32 aa, Artificial Sequence; identical to SEQ ID NO: 1501
  Description of Artificial Sequence: Synthetic polypeptide

SEQ ID NO: 15557 - protein, 32 aa, Artificial Sequence; identical to SEQ ID NO: 3386
  Description of Artificial Sequence: Synthetic polypeptide

SEQ ID NO: 15558 - protein, 32 aa, Artificial Sequence; identical to SEQ ID NO: 1501
  Description of Artificial Sequence: Synthetic polypeptide

SEQ ID NO: 15559 - protein, 32 aa, Artificial Sequence; identical to SEQ ID NO: 1501
  Description of Artificial Sequence: Synthetic polypeptide

SEQ ID NO: 15560 - protein, 32 aa, Artificial Sequence; identical to SEQ ID NO: 3361
  Description of Artificial Sequence: Synthetic polypeptide

SEQ ID NO: 15561 - protein, 32 aa, Artificial Sequence; identical to SEQ ID NO: 3362
  Description of Artificial Sequence: Synthetic polypeptide

SEQ ID NO: 15562 - protein, 32 aa, Artificial Sequence; identical to SEQ ID NO: 3362
  Description of Artificial Sequence: Synthetic polypeptide

SEQ ID NO: 15563 - protein, 32 aa, Artificial Sequence; identical to SEQ ID NO: 1504
  Description of Artificial Sequence: Synthetic polypeptide

SEQ ID NO: 15564 - protein, 32 aa, Artificial Sequence; identical to SEQ ID NO: 1505
  Description of Artificial Sequence: Synthetic polypeptide

SEQ ID NO: 15565 - protein, 32 aa, Artificial Sequence; identical to SEQ ID NO: 1505
  Description of Artificial Sequence: Synthetic polypeptide

SEQ ID NO: 15566 - protein, 9 aa, Artificial Sequence
  Description of Artificial Sequence: Synthetic peptide
QQYYSTPYT

SEQ ID NO: 15567 - protein, 9 aa, Artificial Sequence
  Description of Artificial Sequence: Synthetic peptide
QQYYSYPYT

SEQ ID NO: 15568 - protein, 9 aa, Artificial Sequence
  Description of Artificial Sequence: Synthetic peptide
QQYYSTPWT

SEQ ID NO: 15569 - protein, 9 aa, Artificial Sequence
  Description of Artificial Sequence: Synthetic peptide
QQYYSTPWT

SEQ ID NO: 15570 - protein, 9 aa, Artificial Sequence
  Description of Artificial Sequence: Synthetic peptide
HQSSSLPYT

SEQ ID NO: 15571 - protein, 9 aa, Artificial Sequence
  Description of Artificial Sequence: Synthetic peptide
HQWSSYPPT

SEQ ID NO: 15572 - protein, 9 aa, Artificial Sequence
  Description of Artificial Sequence: Synthetic peptide
LQDYNYPYT

SEQ ID NO: 15573 - protein, 9 aa, Artificial Sequence
  Description of Artificial Sequence: Synthetic peptide
QHHYGTPLT

SEQ ID NO: 15574 - protein, 9 aa, Artificial Sequence
  Description of Artificial Sequence: Synthetic peptide
MQALQTPIT

SEQ ID NO: 15575 - protein, 9 aa, Artificial Sequence
  Description of Artificial Sequence: Synthetic peptide
MQALQTPPT

SEQ ID NO: 15576 - protein, 9 aa, Artificial Sequence
  Description of Artificial Sequence: Synthetic peptide
MQALQTPIT

SEQ ID NO: 15577 - protein, 9 aa, Artificial Sequence
  Description of Artificial Sequence: Synthetic peptide
MQALQTPYT

SEQ ID NO: 15578 - protein, 9 aa, Artificial Sequence
  Description of Artificial Sequence: Synthetic peptide
MQPLQTPPT

SEQ ID NO: 15579 - protein, 9 aa, Artificial Sequence
  Description of Artificial Sequence: Synthetic peptide
MQALQTPPT

SEQ ID NO: 15580 - protein, 9 aa, Artificial Sequence
  Description of Artificial Sequence: Synthetic peptide
MQALQTPPT

SEQ ID NO: 15581 - protein, 9 aa, Artificial Sequence
  Description of Artificial Sequence: Synthetic peptide
MQVLQTPPT

SEQ ID NO: 15582 - protein, 9 aa, Artificial Sequence
  Description of Artificial Sequence: Synthetic peptide
MQALQTPRT

SEQ ID NO: 15583 - protein, 8 aa, Artificial Sequence
  Description of Artificial Sequence: Synthetic peptide
MQALQTPS

SEQ ID NO: 15584 - protein, 8 aa, Artificial Sequence
  Description of Artificial Sequence: Synthetic peptide
MQALQTPS

SEQ ID NO: 15585 - protein, 9 aa, Artificial Sequence
  Description of Artificial Sequence: Synthetic peptide
MQGLQTPRT

SEQ ID NO: 15586 - protein, 9 aa, Artificial Sequence
  Description of Artificial Sequence: Synthetic peptide
MQRIEFPWT

SEQ ID NO: 15587 - protein, 9 aa, Artificial Sequence
  Description of Artificial Sequence: Synthetic peptide
MQGTHWPRT

SEQ ID NO: 15588 - protein, 9 aa, Artificial Sequence
  Description of Artificial Sequence: Synthetic peptide
MQALQTPRT

SEQ ID NO: 15589 - protein, 9 aa, Artificial Sequence
  Description of Artificial Sequence: Synthetic peptide
MQALQTPRT

SEQ ID NO: 15590 - protein, 8 aa, Artificial Sequence
  Description of Artificial Sequence: Synthetic peptide
MQALQTPS

SEQ ID NO: 15591 - protein, 9 aa, Artificial Sequence
  Description of Artificial Sequence: Synthetic peptide
MQALQTPWT

SEQ ID NO: 15592 - protein, 8 aa, Artificial Sequence
  Description of Artificial Sequence: Synthetic peptide
MQALQTPS

SEQ ID NO: 15593 - protein, 9 aa, Artificial Sequence
  Description of Artificial Sequence: Synthetic peptide
MQALQTPWT

SEQ ID NO: 15594 - protein, 9 aa, Artificial Sequence
  Description of Artificial Sequence: Synthetic peptide
QQYGSSPFT

SEQ ID NO: 15595 - protein, 9 aa, Artificial Sequence
  Description of Artificial Sequence: Synthetic peptide
QQYGRSLFT

SEQ ID NO: 15596 - protein, 9 aa, Artificial Sequence
  Description of Artificial Sequence: Synthetic peptide
QQYGSSPFT

SEQ ID NO: 15597 - protein, 9 aa, Artificial Sequence
  Description of Artificial Sequence: Synthetic peptide
QQYGSSPLT

SEQ ID NO: 15598 - protein, 9 aa, Artificial Sequence
  Description of Artificial Sequence: Synthetic peptide
QQYGSSPLT

SEQ ID NO: 15599 - protein, 9 aa, Artificial Sequence
  Description of Artificial Sequence: Synthetic peptide
QQYGSSPLT

SEQ ID NO: 15600 - protein, 8 aa, Artificial Sequence
  Description of Artificial Sequence: Synthetic peptide
QQYGSSLT

SEQ ID NO: 15601 - protein, 9 aa, Artificial Sequence
  Description of Artificial Sequence: Synthetic peptide
QQYGSSPLT

SEQ ID NO: 15602 - protein, 9 aa, Artificial Sequence
  Description of Artificial Sequence: Synthetic peptide
QQYGTSPLT

SEQ ID NO: 15603 - protein, 9 aa, Artificial Sequence
  Description of Artificial Sequence: Synthetic peptide
MQALQTPFT

SEQ ID NO: 15604 - protein, 9 aa, Artificial Sequence
  Description of Artificial Sequence: Synthetic peptide
MQALQTPFT

SEQ ID NO: 15605 - protein, 9 aa, Artificial Sequence
  Description of Artificial Sequence: Synthetic peptide
MQALQTPFT

SEQ ID NO: 15606 - protein, 9 aa, Artificial Sequence
  Description of Artificial Sequence: Synthetic peptide
MQGTHWPFT

SEQ ID NO: 15607 - protein, 9 aa, Artificial Sequence
  Description of Artificial Sequence: Synthetic peptide
MQALQTPFT

SEQ ID NO: 15608 - protein, 9 aa, Artificial Sequence
  Description of Artificial Sequence: Synthetic peptide
MQALQTPFT

SEQ ID NO: 15609 - protein, 9 aa, Artificial Sequence
  Description of Artificial Sequence: Synthetic peptide
MQALQTPFT

SEQ ID NO: 15610 - protein, 9 aa, Artificial Sequence
  Description of Artificial Sequence: Synthetic peptide
MQALQTPFT

SEQ ID NO: 15611 - protein, 9 aa, Artificial Sequence
  Description of Artificial Sequence: Synthetic peptide
MQALQTPFT

SEQ ID NO: 15612 - protein, 9 aa, Artificial Sequence
  Description of Artificial Sequence: Synthetic peptide
MQALQTPFT

SEQ ID NO: 15613 - protein, 9 aa, Artificial Sequence
  Description of Artificial Sequence: Synthetic peptide
MQALQTPFT

SEQ ID NO: 15614 - protein, 9 aa, Artificial Sequence
  Description of Artificial Sequence: Synthetic peptide
MQGLQTPFT

SEQ ID NO: 15615 - protein, 9 aa, Artificial Sequence
  Description of Artificial Sequence: Synthetic peptide
QQANSFPWT

SEQ ID NO: 15616 - protein, 9 aa, Artificial Sequence
  Description of Artificial Sequence: Synthetic peptide
QQANSFPPT

SEQ ID NO: 15617 - protein, 9 aa, Artificial Sequence
  Description of Artificial Sequence: Synthetic peptide
QQSYSTPPT

SEQ ID NO: 15618 - protein, 9 aa, Artificial Sequence
  Description of Artificial Sequence: Synthetic peptide
MQALQTPLT

SEQ ID NO: 15619 - protein, 9 aa, Artificial Sequence
  Description of Artificial Sequence: Synthetic peptide
MQALQTPLT

SEQ ID NO: 15620 - protein, 9 aa, Artificial Sequence
  Description of Artificial Sequence: Synthetic peptide
MQGTHWPLT

SEQ ID NO: 15621 - protein, 9 aa, Artificial Sequence
  Description of Artificial Sequence: Synthetic peptide
MQGTHWPLT

SEQ ID NO: 15622 - protein, 8 aa, Artificial Sequence
  Description of Artificial Sequence: Synthetic peptide
MQALQTPH

SEQ ID NO: 15623 - protein, 9 aa, Artificial Sequence
  Description of Artificial Sequence: Synthetic peptide
MQALQTPLT

SEQ ID NO: 15624 - protein, 9 aa, Artificial Sequence
  Description of Artificial Sequence: Synthetic peptide
MQRIEFPYT

SEQ ID NO: 15625 - protein, 9 aa, Artificial Sequence
  Description of Artificial Sequence: Synthetic peptide
MQALQTPCS

SEQ ID NO: 15626 - protein, 9 aa, Artificial Sequence
  Description of Artificial Sequence: Synthetic peptide
MQSLHLPPT

SEQ ID NO: 15627 - protein, 9 aa, Artificial Sequence
  Description of Artificial Sequence: Synthetic peptide
QQSYSTPWT

SEQ ID NO: 15628 - protein, 9 aa, Artificial Sequence
  Description of Artificial Sequence: Synthetic peptide
QQSYRTPPT

SEQ ID NO: 15629 - protein, 9 aa, Artificial Sequence
  Description of Artificial Sequence: Synthetic peptide
QQSYSTPPT

SEQ ID NO: 15630 - protein, 9 aa, Artificial Sequence
  Description of Artificial Sequence: Synthetic peptide
QQSYSTPPT

SEQ ID NO: 15631 - protein, 9 aa, Artificial Sequence
  Description of Artificial Sequence: Synthetic peptide
QQSYSVPPT

SEQ ID NO: 15632 - protein, 9 aa, Artificial Sequence
  Description of Artificial Sequence: Synthetic peptide
QQSYYYPTL

SEQ ID NO: 15633 - protein, 9 aa, Artificial Sequence
  Description of Artificial Sequence: Synthetic peptide
QQSYFPVVE

SEQ ID NO: 15634 - protein, 9 aa, Artificial Sequence
  Description of Artificial Sequence: Synthetic peptide
QQSYTPPTT

SEQ ID NO: 15635 - protein, 9 aa, Artificial Sequence
  Description of Artificial Sequence: Synthetic peptide
MQRIEFPIT

SEQ ID NO: 15636 - protein, 9 aa, Artificial Sequence
  Description of Artificial Sequence: Synthetic peptide
MQALQTPIT

SEQ ID NO: 15637 - protein, 9 aa, Artificial Sequence
  Description of Artificial Sequence: Synthetic peptide
MQALQTPIT

SEQ ID NO: 15638 - protein, 9 aa, Artificial Sequence
  Description of Artificial Sequence: Synthetic peptide
MQALQTPWT

SEQ ID NO: 15639 - protein, 9 aa, Artificial Sequence
  Description of Artificial Sequence: Synthetic peptide
MQALQTPWT

SEQ ID NO: 15640 - protein, 9 aa, Artificial Sequence
  Description of Artificial Sequence: Synthetic peptide
MQSIQLPWT

SEQ ID NO: 15641 - protein, 9 aa, Artificial Sequence
  Description of Artificial Sequence: Synthetic peptide
MQALQTPPT

SEQ ID NO: 15642 - protein, 9 aa, Artificial Sequence
  Description of Artificial Sequence: Synthetic peptide
MQALQTPRT

SEQ ID NO: 15643 - protein, 9 aa, Artificial Sequence
  Description of Artificial Sequence: Synthetic peptide
MQALQTPRT

SEQ ID NO: 15644 - protein, 9 aa, Artificial Sequence
  Description of Artificial Sequence: Synthetic peptide
MQALQTPRT

SEQ ID NO: 15645 - protein, 9 aa, Artificial Sequence
  Description of Artificial Sequence: Synthetic peptide
MQALQTPRT

SEQ ID NO: 15646 - protein, 9 aa, Artificial Sequence
  Description of Artificial Sequence: Synthetic peptide
MQALQTPRT

SEQ ID NO: 15647 - protein, 9 aa, Artificial Sequence
  Description of Artificial Sequence: Synthetic peptide
MQALQTPRT

SEQ ID NO: 15648 - protein, 9 aa, Artificial Sequence
  Description of Artificial Sequence: Synthetic peptide
MQRIEFPLT

SEQ ID NO: 15649 - protein, 9 aa, Artificial Sequence
  Description of Artificial Sequence: Synthetic peptide
MQALQTPLT

SEQ ID NO: 15650 - protein, 8 aa, Artificial Sequence
  Description of Artificial Sequence: Synthetic peptide
MQALQSLT

SEQ ID NO: 15651 - protein, 9 aa, Artificial Sequence
  Description of Artificial Sequence: Synthetic peptide
MQALQTPLT

SEQ ID NO: 15652 - protein, 9 aa, Artificial Sequence
  Description of Artificial Sequence: Synthetic peptide
QKYNSAPFT

SEQ ID NO: 15653 - protein, 9 aa, Artificial Sequence
  Description of Artificial Sequence: Synthetic peptide
QQSYSTPFT

SEQ ID NO: 15654 - protein, 9 aa, Artificial Sequence
  Description of Artificial Sequence: Synthetic peptide
QKYYSAPFT

SEQ ID NO: 15655 - protein, 9 aa, Artificial Sequence
  Description of Artificial Sequence: Synthetic peptide
QKYNSAPFT

SEQ ID NO: 15656 - protein, 9 aa, Artificial Sequence
  Description of Artificial Sequence: Synthetic peptide
QKYNSAPFT

SEQ ID NO: 15657 - protein, 9 aa, Artificial Sequence
  Description of Artificial Sequence: Synthetic peptide
QKYNSAPFT

SEQ ID NO: 15658 - protein, 9 aa, Artificial Sequence
  Description of Artificial Sequence: Synthetic peptide
QKYNSAPFT

SEQ ID NO: 15659 - protein, 9 aa, Artificial Sequence
  Description of Artificial Sequence: Synthetic peptide
MQRIEFPFT

SEQ ID NO: 15660 - protein, 9 aa, Artificial Sequence
  Description of Artificial Sequence: Synthetic peptide
MQGTHWPFT

SEQ ID NO: 15661 - protein, 9 aa, Artificial Sequence
  Description of Artificial Sequence: Synthetic peptide
QKYNSAPWT

SEQ ID NO: 15662 - protein, 9 aa, Artificial Sequence
  Description of Artificial Sequence: Synthetic peptide
QQSYSTPPT

SEQ ID NO: 15663 - protein, 9 aa, Artificial Sequence
  Description of Artificial Sequence: Synthetic peptide
MQGIHLPIT

SEQ ID NO: 15664 - protein, 9 aa, Artificial Sequence
  Description of Artificial Sequence: Synthetic peptide
MQALQTPIT

SEQ ID NO: 15665 - protein, 9 aa, Artificial Sequence
  Description of Artificial Sequence: Synthetic peptide
QQYYSTPWT

SEQ ID NO: 15666 - protein, 9 aa, Artificial Sequence
  Description of Artificial Sequence: Synthetic peptide
QQYYSTPWT

SEQ ID NO: 15667 - protein, 9 aa, Artificial Sequence
  Description of Artificial Sequence: Synthetic peptide
QQYYSTPWT

SEQ ID NO: 15668 - protein, 9 aa, Artificial Sequence
  Description of Artificial Sequence: Synthetic peptide
QQYYSTPWT

SEQ ID NO: 15669 - protein, 9 aa, Artificial Sequence
  Description of Artificial Sequence: Synthetic peptide
QQYDNLPWT

SEQ ID NO: 15670 - protein, 9 aa, Artificial Sequence
  Description of Artificial Sequence: Synthetic peptide
QQSYSIPPT

SEQ ID NO: 15671 - protein, 9 aa, Artificial Sequence
  Description of Artificial Sequence: Synthetic peptide
QQYYSTPLT

SEQ ID NO: 15672 - protein, 9 aa, Artificial Sequence
  Description of Artificial Sequence: Synthetic peptide
QQYYSTPLT

SEQ ID NO: 15673 - protein, 9 aa, Artificial Sequence
  Description of Artificial Sequence: Synthetic peptide
QQYYSTPLT

SEQ ID NO: 15674 - protein, 9 aa, Artificial Sequence
  Description of Artificial Sequence: Synthetic peptide
QQYYSTPLT

SEQ ID NO: 15675 - protein, 9 aa, Artificial Sequence
  Description of Artificial Sequence: Synthetic peptide
QQYYSTPLT

SEQ ID NO: 15676 - protein, 9 aa, Artificial Sequence
  Description of Artificial Sequence: Synthetic peptide
QQSYSTPYT

SEQ ID NO: 15677 - protein, 9 aa, Artificial Sequence
  Description of Artificial Sequence: Synthetic peptide
QQSYSTPFT

SEQ ID NO: 15678 - protein, 9 aa, Artificial Sequence
  Description of Artificial Sequence: Synthetic peptide
QQSYSTPFT

SEQ ID NO: 15679 - protein, 9 aa, Artificial Sequence
  Description of Artificial Sequence: Synthetic peptide
QQTYSMPFT

SEQ ID NO: 15680 - protein, 9 aa, Artificial Sequence
  Description of Artificial Sequence: Synthetic peptide
QQSYITPFT

SEQ ID NO: 15681 - protein, 9 aa, Artificial Sequence
  Description of Artificial Sequence: Synthetic peptide
QQSYSTPFT

SEQ ID NO: 15682 - protein, 9 aa, Artificial Sequence
  Description of Artificial Sequence: Synthetic peptide
QQTYSSPFT

SEQ ID NO: 15683 - protein, 9 aa, Artificial Sequence
  Description of Artificial Sequence: Synthetic peptide
QQTYSMPFT

SEQ ID NO: 15684 - protein, 9 aa, Artificial Sequence
  Description of Artificial Sequence: Synthetic peptide
IQAYTSPFT

SEQ ID NO: 15685 - protein, 9 aa, Artificial Sequence
  Description of Artificial Sequence: Synthetic peptide
QQTYSSPFT

SEQ ID NO: 15686 - protein, 9 aa, Artificial Sequence
  Description of Artificial Sequence: Synthetic peptide
QQSYSTPLT

SEQ ID NO: 15687 - protein, 9 aa, Artificial Sequence
  Description of Artificial Sequence: Synthetic peptide
QQSYSTPLT

SEQ ID NO: 15688 - protein, 9 aa, Artificial Sequence
  Description of Artificial Sequence: Synthetic peptide
QQSYSIPLT

SEQ ID NO: 15689 - protein, 9 aa, Artificial Sequence
  Description of Artificial Sequence: Synthetic peptide
QQTYSMPFT

SEQ ID NO: 15690 - protein, 9 aa, Artificial Sequence
  Description of Artificial Sequence: Synthetic peptide
QQTYSMPFT

SEQ ID NO: 15691 - protein, 9 aa, Artificial Sequence
  Description of Artificial Sequence: Synthetic peptide
QQSYSTPFT

SEQ ID NO: 15692 - protein, 9 aa, Artificial Sequence
  Description of Artificial Sequence: Synthetic peptide
QQSYSIPFT

SEQ ID NO: 15693 - protein, 9 aa, Artificial Sequence
  Description of Artificial Sequence: Synthetic peptide
QQTYSMPFT

SEQ ID NO: 15694 - protein, 9 aa, Artificial Sequence
  Description of Artificial Sequence: Synthetic peptide
QQSYSTPFT

SEQ ID NO: 15695 - protein, 9 aa, Artificial Sequence
  Description of Artificial Sequence: Synthetic peptide
QQTYSMPFT

SEQ ID NO: 15696 - protein, 9 aa, Artificial Sequence
  Description of Artificial Sequence: Synthetic peptide
QQSYSTPFT

SEQ ID NO: 15697 - protein, 9 aa, Artificial Sequence
  Description of Artificial Sequence: Synthetic peptide
QQTYSMPFT

SEQ ID NO: 15698 - protein, 9 aa, Artificial Sequence
  Description of Artificial Sequence: Synthetic peptide
QQSYSTPFT

SEQ ID NO: 15699 - protein, 9 aa, Artificial Sequence
  Description of Artificial Sequence: Synthetic peptide
QQSYSTPFT

SEQ ID NO: 15700 - protein, 9 aa, Artificial Sequence
  Description of Artificial Sequence: Synthetic peptide
QQSYTTPFT

SEQ ID NO: 15701 - protein, 9 aa, Artificial Sequence
  Description of Artificial Sequence: Synthetic peptide
QQTYSMPFT

SEQ ID NO: 15702 - protein, 9 aa, Artificial Sequence
  Description of Artificial Sequence: Synthetic peptide
QQSYSSPFT

SEQ ID NO: 15703 - protein, 9 aa, Artificial Sequence
  Description of Artificial Sequence: Synthetic peptide
QQTYSMPFT

SEQ ID NO: 15704 - protein, 9 aa, Artificial Sequence
  Description of Artificial Sequence: Synthetic peptide
QQTYSMPFT

SEQ ID NO: 15705 - protein, 9 aa, Artificial Sequence
  Description of Artificial Sequence: Synthetic peptide
QQTYSMPFT

SEQ ID NO: 15706 - protein, 9 aa, Artificial Sequence
  Description of Artificial Sequence: Synthetic peptide
QQTYSMPFT

SEQ ID NO: 15707 - protein, 9 aa, Artificial Sequence
  Description of Artificial Sequence: Synthetic peptide
QQSYSSPFT

SEQ ID NO: 15708 - protein, 9 aa, Artificial Sequence
  Description of Artificial Sequence: Synthetic peptide
QQSYSSPFT

SEQ ID NO: 15709 - protein, 9 aa, Artificial Sequence
  Description of Artificial Sequence: Synthetic peptide
QQSYITPFT

SEQ ID NO: 15710 - protein, 9 aa, Artificial Sequence
  Description of Artificial Sequence: Synthetic peptide
QQTYSMPFT

SEQ ID NO: 15711 - protein, 9 aa, Artificial Sequence
  Description of Artificial Sequence: Synthetic peptide
QQTYSMPFT

SEQ ID NO: 15712 - protein, 9 aa, Artificial Sequence
  Description of Artificial Sequence: Synthetic peptide
QQTYSMPFT

SEQ ID NO: 15713 - protein, 9 aa, Artificial Sequence
  Description of Artificial Sequence: Synthetic peptide
QQANSFPLT

SEQ ID NO: 15714 - protein, 9 aa, Artificial Sequence
  Description of Artificial Sequence: Synthetic peptide
QQSYSTPLT

SEQ ID NO: 15715 - protein, 9 aa, Artificial Sequence
  Description of Artificial Sequence: Synthetic peptide
QQYGSSPWT

SEQ ID NO: 15716 - protein, 9 aa, Artificial Sequence
  Description of Artificial Sequence: Synthetic peptide
MQALQTPRT

SEQ ID NO: 15717 - protein, 9 aa, Artificial Sequence
  Description of Artificial Sequence: Synthetic peptide
QKYNSAPYT

SEQ ID NO: 15718 - protein, 9 aa, Artificial Sequence
  Description of Artificial Sequence: Synthetic peptide
QKYNSAPFT

SEQ ID NO: 15719 - protein, 9 aa, Artificial Sequence
  Description of Artificial Sequence: Synthetic peptide
QQYYSTPIT

SEQ ID NO: 15720 - protein, 9 aa, Artificial Sequence
  Description of Artificial Sequence: Synthetic peptide
QQFYSTPIT

SEQ ID NO: 15721 - protein, 9 aa, Artificial Sequence
  Description of Artificial Sequence: Synthetic peptide
QQFYSTPIT

SEQ ID NO: 15722 - protein, 9 aa, Artificial Sequence
  Description of Artificial Sequence: Synthetic peptide
QQSYSTPIT

SEQ ID NO: 15723 - protein, 9 aa, Artificial Sequence
  Description of Artificial Sequence: Synthetic peptide
QQSYSTPIT

SEQ ID NO: 15724 - protein, 11 aa, Artificial Sequence
  Description of Artificial Sequence: Synthetic peptide
SSYTSSSTLVV

SEQ ID NO: 15725 - protein, 10 aa, Artificial Sequence
  Description of Artificial Sequence: Synthetic peptide
SSYTSSSTLV

SEQ ID NO: 15726 - protein, 11 aa, Artificial Sequence
  Description of Artificial Sequence: Synthetic peptide
AAWDDSLSGVV

SEQ ID NO: 15727 - protein, 11 aa, Artificial Sequence
  Description of Artificial Sequence: Synthetic peptide
AAWDDSLSGVV

SEQ ID NO: 15728 - protein, 11 aa, Artificial Sequence
  Description of Artificial Sequence: Synthetic peptide
SAWDSSLSAWV

SEQ ID NO: 15729 - protein, 11 aa, Artificial Sequence
  Description of Artificial Sequence: Synthetic peptide
SAWDSSLSAWV

SEQ ID NO: 15730 - protein, 11 aa, Artificial Sequence
  Description of Artificial Sequence: Synthetic peptide
SAWDSSLSAWV

SEQ ID NO: 15731 - protein, 11 aa, Artificial Sequence
  Description of Artificial Sequence: Synthetic peptide
SSYAGSNNFVV

SEQ ID NO: 15732 - protein, 10 aa, Artificial Sequence
  Description of Artificial Sequence: Synthetic peptide
SSYAGSNNVV

SEQ ID NO: 15733 - protein, 11 aa, Artificial Sequence
  Description of Artificial Sequence: Synthetic peptide
SAWDSSLSAVV

SEQ ID NO: 15734 - protein, 11 aa, Artificial Sequence
  Description of Artificial Sequence: Synthetic peptide
SAWDSSLSAVV

SEQ ID NO: 15735 - protein, 11 aa, Artificial Sequence
  Description of Artificial Sequence: Synthetic peptide
QVWDSSSDHVV

SEQ ID NO: 15736 - protein, 11 aa, Artificial Sequence
  Description of Artificial Sequence: Synthetic peptide
QVWDSSSDHVV

SEQ ID NO: 15737 - protein, 11 aa, Artificial Sequence
  Description of Artificial Sequence: Synthetic peptide
QVWDSSSDHVV

SEQ ID NO: 15738 - protein, 11 aa, Artificial Sequence
  Description of Artificial Sequence: Synthetic peptide
QVWDSSSDHVV

SEQ ID NO: 15739 - protein, 11 aa, Artificial Sequence
  Description of Artificial Sequence: Synthetic peptide
QVWDSSSDHVV

SEQ ID NO: 15740 - protein, 11 aa, Artificial Sequence
  Description of Artificial Sequence: Synthetic peptide
QVWDSSSDHVV

SEQ ID NO: 15741 - protein, 11 aa, Artificial Sequence
  Description of Artificial Sequence: Synthetic peptide
QVWDSSSDHVV

SEQ ID NO: 15742 - protein, 11 aa, Artificial Sequence
  Description of Artificial Sequence: Synthetic peptide
QVWDSSSDHVV

SEQ ID NO: 15743 - protein, 11 aa, Artificial Sequence
  Description of Artificial Sequence: Synthetic peptide
QVWDSSSDHVV

SEQ ID NO: 15744 - protein, 11 aa, Artificial Sequence
  Description of Artificial Sequence: Synthetic peptide
QVWDSSSDHVV

SEQ ID NO: 15745 - protein, 11 aa, Artificial Sequence
  Description of Artificial Sequence: Synthetic peptide
QVWDSSSDHVV

SEQ ID NO: 15746 - protein, 11 aa, Artificial Sequence
  Description of Artificial Sequence: Synthetic peptide
QVWDSSSDHVV

SEQ ID NO: 15747 - protein, 11 aa, Artificial Sequence
  Description of Artificial Sequence: Synthetic peptide
QVWDSSSDHVV

SEQ ID NO: 15748 - protein, 11 aa, Artificial Sequence
  Description of Artificial Sequence: Synthetic peptide
QVWDSSSDHAV

SEQ ID NO: 15749 - protein, 11 aa, Artificial Sequence
  Description of Artificial Sequence: Synthetic peptide
QVWDSSSDHVV

SEQ ID NO: 15750 - protein, 11 aa, Artificial Sequence
  Description of Artificial Sequence: Synthetic peptide
QVWDSSSDHVV

SEQ ID NO: 15751 - protein, 11 aa, Artificial Sequence
  Description of Artificial Sequence: Synthetic peptide
QVWDSSSDHVV

SEQ ID NO: 15752 - protein, 11 aa, Artificial Sequence
  Description of Artificial Sequence: Synthetic peptide
QVWDSSSDHVV

SEQ ID NO: 15753 - protein, 11 aa, Artificial Sequence
  Description of Artificial Sequence: Synthetic peptide
QVWDSSSDHVV

SEQ ID NO: 15754 - protein, 11 aa, Artificial Sequence
  Description of Artificial Sequence: Synthetic peptide
QVWDSSSDHVI

SEQ ID NO: 15755 - protein, 11 aa, Artificial Sequence
  Description of Artificial Sequence: Synthetic peptide
QVWDSNSDHVV

SEQ ID NO: 15756 - protein, 11 aa, Artificial Sequence
  Description of Artificial Sequence: Synthetic peptide
QVWDSSSDHVI

SEQ ID NO: 15757 - protein, 11 aa, Artificial Sequence
  Description of Artificial Sequence: Synthetic peptide
QVWDSSSDHVV

SEQ ID NO: 15758 - protein, 11 aa, Artificial Sequence
  Description of Artificial Sequence: Synthetic peptide
QVWDSSSDHVV

SEQ ID NO: 15759 - protein, 11 aa, Artificial Sequence
  Description of Artificial Sequence: Synthetic peptide
QVWDSSSDHVV

SEQ ID NO: 15760 - protein, 11 aa, Artificial Sequence
  Description of Artificial Sequence: Synthetic peptide
QVWDSSSDHVV

SEQ ID NO: 15761 - protein, 11 aa, Artificial Sequence
  Description of Artificial Sequence: Synthetic peptide
QVWDSSSDHVV

SEQ ID NO: 15762 - protein, 11 aa, Artificial Sequence
  Description of Artificial Sequence: Synthetic peptide
QVWDSSSDHVM

SEQ ID NO: 15763 - protein, 11 aa, Artificial Sequence
  Description of Artificial Sequence: Synthetic peptide
QVWDSSSDHVV

SEQ ID NO: 15764 - protein, 11 aa, Artificial Sequence
  Description of Artificial Sequence: Synthetic peptide
QVWDSSSDHVV

SEQ ID NO: 15765 - protein, 11 aa, Artificial Sequence
  Description of Artificial Sequence: Synthetic peptide
QVWDSSSDHVV

SEQ ID NO: 15766 - protein, 11 aa, Artificial Sequence
  Description of Artificial Sequence: Synthetic peptide
QVWDSSSDHVV

SEQ ID NO: 15767 - protein, 11 aa, Artificial Sequence
  Description of Artificial Sequence: Synthetic peptide
QVWDSSSDHVV

SEQ ID NO: 15768 - protein, 11 aa, Artificial Sequence
  Description of Artificial Sequence: Synthetic peptide
QVWDSSSDHVV

SEQ ID NO: 15769 - protein, 11 aa, Artificial Sequence
  Description of Artificial Sequence: Synthetic peptide
QVWDSSSDHVV

SEQ ID NO: 15770 - protein, 12 aa, Artificial Sequence
  Description of Artificial Sequence: Synthetic peptide
QVWDSSSDHHVV

SEQ ID NO: 15771 - protein, 11 aa, Artificial Sequence
  Description of Artificial Sequence: Synthetic peptide
QVWDSSSDHVV

SEQ ID NO: 15772 - protein, 11 aa, Artificial Sequence
  Description of Artificial Sequence: Synthetic peptide
QVWDSSSDHVV

SEQ ID NO: 15773 - protein, 11 aa, Artificial Sequence
  Description of Artificial Sequence: Synthetic peptide
QVWDSSSDHVV

SEQ ID NO: 15774 - protein, 11 aa, Artificial Sequence
  Description of Artificial Sequence: Synthetic peptide
QVWDSSSDHVV

SEQ ID NO: 15775 - protein, 11 aa, Artificial Sequence
  Description of Artificial Sequence: Synthetic peptide
QVWDSSSDHVI

SEQ ID NO: 15776 - protein, 11 aa, Artificial Sequence
  Description of Artificial Sequence: Synthetic peptide
QVWDSSSDHVV

SEQ ID NO: 15777 - protein, 11 aa, Artificial Sequence
  Description of Artificial Sequence: Synthetic peptide
QVWDSSSDHVV

SEQ ID NO: 15778 - protein, 11 aa, Artificial Sequence
  Description of Artificial Sequence: Synthetic peptide
QVWDSSSDHVV

SEQ ID NO: 15779 - protein, 11 aa, Artificial Sequence
  Description of Artificial Sequence: Synthetic peptide
QVWDYSSDHVV

SEQ ID NO: 15780 - protein, 11 aa, Artificial Sequence
  Description of Artificial Sequence: Synthetic peptide
QVWDYSSDHVV

SEQ ID NO: 15781 - protein, 11 aa, Artificial Sequence
  Description of Artificial Sequence: Synthetic peptide
QVWDSSSDHVV

SEQ ID NO: 15782 - protein, 11 aa, Artificial Sequence
  Description of Artificial Sequence: Synthetic peptide
QVWDSSSDHVV

SEQ ID NO: 15783 - protein, 11 aa, Artificial Sequence
  Description of Artificial Sequence: Synthetic peptide
QVWDYRYLSQV

SEQ ID NO: 15784 - protein, 11 aa, Artificial Sequence
  Description of Artificial Sequence: Synthetic peptide
QVWDYSGQRQV

SEQ ID NO: 15785 - protein, 12 aa, Artificial Sequence
  Description of Artificial Sequence: Synthetic peptide
QVWDASAGYGVV

SEQ ID NO: 15786 - protein, 11 aa, Artificial Sequence
  Description of Artificial Sequence: Synthetic peptide
QVWDYSPLRHV

SEQ ID NO: 15787 - protein, 11 aa, Artificial Sequence
  Description of Artificial Sequence: Synthetic peptide
QVWDYYSNRAV

SEQ ID NO: 15788 - protein, 11 aa, Artificial Sequence
  Description of Artificial Sequence: Synthetic peptide
QVWDYRYLSQV

SEQ ID NO: 15789 - protein, 11 aa, Artificial Sequence
  Description of Artificial Sequence: Synthetic peptide
QVWDYRYLSQV

SEQ ID NO: 15790 - protein, 11 aa, Artificial Sequence
  Description of Artificial Sequence: Synthetic peptide
QVWDYSGQRQV

SEQ ID NO: 15791 - protein, 11 aa, Artificial Sequence
  Description of Artificial Sequence: Synthetic peptide
QVWDYSGQRQV

SEQ ID NO: 15792 - protein, 11 aa, Artificial Sequence
  Description of Artificial Sequence: Synthetic peptide
QVWDYVAPRHV

SEQ ID NO: 15793 - protein, 11 aa, Artificial Sequence
  Description of Artificial Sequence: Synthetic peptide
QVWDYVAPRHV

SEQ ID NO: 15794 - protein, 11 aa, Artificial Sequence
  Description of Artificial Sequence: Synthetic peptide
QVWDSSSDHWV

SEQ ID NO: 15795 - protein, 11 aa, Artificial Sequence
  Description of Artificial Sequence: Synthetic peptide
QVWDYRTLDWV

SEQ ID NO: 15796 - protein, 11 aa, Artificial Sequence
  Description of Artificial Sequence: Synthetic peptide
QVWDYRTLDWV

SEQ ID NO: 15797 - protein, 13 aa, Artificial Sequence
  Description of Artificial Sequence: Synthetic peptide
DIVVVVAATYFDY

SEQ ID NO: 15798 - protein, 10 aa, Artificial Sequence
  Description of Artificial Sequence: Synthetic peptide
DGVFYAPLAY

SEQ ID NO: 15799 - protein, 10 aa, Artificial Sequence
  Description of Artificial Sequence: Synthetic peptide
GYSYGYYFDY

SEQ ID NO: 15800 - protein, 13 aa, Artificial Sequence
  Description of Artificial Sequence: Synthetic peptide
GNYFGSSEAYFDY

SEQ ID NO: 15801 - protein, 10 aa, Artificial Sequence
  Description of Artificial Sequence: Synthetic peptide
VQLERDAFDI

SEQ ID NO: 15802 - protein, 11 aa, Artificial Sequence
  Description of Artificial Sequence: Synthetic peptide
RQLNHVFAMDY

SEQ ID NO: 15803 - protein, 15 aa, Artificial Sequence
  Description of Artificial Sequence: Synthetic peptide
GYSYGYYYYYYGMDV

SEQ ID NO: 15804 - protein, 14 aa, Artificial Sequence
  Description of Artificial Sequence: Synthetic peptide
GGGYSNGYDYGMDV

SEQ ID NO: 15805 - protein, 14 aa, Artificial Sequence
  Description of Artificial Sequence: Synthetic peptide
GGGYSNGYDYGMDV

SEQ ID NO: 15806 - protein, 16 aa, Artificial Sequence
  Description of Artificial Sequence: Synthetic peptide
GYSGYDYYYYYYGMDV

SEQ ID NO: 15807 - protein, 14 aa, Artificial Sequence
  Description of Artificial Sequence: Synthetic peptide
GGGYSYGYDYGMDV

SEQ ID NO: 15808 - protein, 14 aa, Artificial Sequence
  Description of Artificial Sequence: Synthetic peptide
GGGYSYGYDYGMDV

SEQ ID NO: 15809 - protein, 14 aa, Artificial Sequence
  Description of Artificial Sequence: Synthetic peptide
GGGYSYGYDYGMDV

SEQ ID NO: 15810 - protein, 15 aa, Artificial Sequence
  Description of Artificial Sequence: Synthetic peptide
GYSYGYYYYYYGMDV

SEQ ID NO: 15811 - protein, 14 aa, Artificial Sequence
  Description of Artificial Sequence: Synthetic peptide
GGGYSHGYDYGMDV

SEQ ID NO: 15812 - protein, 14 aa, Artificial Sequence
  Description of Artificial Sequence: Synthetic peptide
GGGYSDGYDYGMDV

SEQ ID NO: 15813 - protein, 14 aa, Artificial Sequence
  Description of Artificial Sequence: Synthetic peptide
GGGYSDGYDYGMDV

SEQ ID NO: 15814 - protein, 14 aa, Artificial Sequence
  Description of Artificial Sequence: Synthetic peptide
GGGYSHGYDYGMDV

SEQ ID NO: 15815 - protein, 14 aa, Artificial Sequence
  Description of Artificial Sequence: Synthetic peptide
GGGYSDGYDYGMDV

SEQ ID NO: 15816 - protein, 14 aa, Artificial Sequence
  Description of Artificial Sequence: Synthetic peptide
GGGYSHGYDYGMDV

SEQ ID NO: 15817 - protein, 14 aa, Artificial Sequence
  Description of Artificial Sequence: Synthetic peptide
GGGYSDGYDYGMDV

SEQ ID NO: 15818 - protein, 14 aa, Artificial Sequence
  Description of Artificial Sequence: Synthetic peptide
GGGYSDGYDYGMDV

SEQ ID NO: 15819 - protein, 14 aa, Artificial Sequence
  Description of Artificial Sequence: Synthetic peptide
GGGYSDGYDYGMDV

SEQ ID NO: 15820 - protein, 14 aa, Artificial Sequence
  Description of Artificial Sequence: Synthetic peptide
GGGYSDGYDYGMDV

SEQ ID NO: 15821 - protein, 9 aa, Artificial Sequence
  Description of Artificial Sequence: Synthetic peptide
VLRYFDWLL

SEQ ID NO: 15822 - protein, 4 aa, Artificial Sequence
  Description of Artificial Sequence: Synthetic peptide
YFDY

SEQ ID NO: 15823 - protein, 11 aa, Artificial Sequence
  Description of Artificial Sequence: Synthetic peptide
HLRYFDWPLDY

SEQ ID NO: 15824 - protein, 11 aa, Artificial Sequence
  Description of Artificial Sequence: Synthetic peptide
HLRYSDWPLDY

SEQ ID NO: 15825 - protein, 11 aa, Artificial Sequence
  Description of Artificial Sequence: Synthetic peptide
HLRYFDWPLDY

SEQ ID NO: 15826 - protein, 11 aa, Artificial Sequence
  Description of Artificial Sequence: Synthetic peptide
HLRYSDWPLDY

SEQ ID NO: 15827 - protein, 11 aa, Artificial Sequence
  Description of Artificial Sequence: Synthetic peptide
HLRYFDWPLDY

SEQ ID NO: 15828 - protein, 14 aa, Artificial Sequence
  Description of Artificial Sequence: Synthetic peptide
VQLERYYYYYGMDV

SEQ ID NO: 15829 - protein, 12 aa, Artificial Sequence
  Description of Artificial Sequence: Synthetic peptide
EQWPNYYYGMDV

SEQ ID NO: 15830 - protein, 12 aa, Artificial Sequence
  Description of Artificial Sequence: Synthetic peptide
EQWPNYYYGLGV

SEQ ID NO: 15831 - protein, 16 aa, Artificial Sequence
  Description of Artificial Sequence: Synthetic peptide
GYSGYDYYYYYYGMDV

SEQ ID NO: 15832 - protein, 14 aa, Artificial Sequence
  Description of Artificial Sequence: Synthetic peptide
GGGYSYGYDYGMDV

SEQ ID NO: 15833 - protein, 14 aa, Artificial Sequence
  Description of Artificial Sequence: Synthetic peptide
GGGYSYGYDYGMDV

SEQ ID NO: 15834 - protein, 14 aa, Artificial Sequence
  Description of Artificial Sequence: Synthetic peptide
GGGYSYGYDYGMDV

SEQ ID NO: 15835 - protein, 14 aa, Artificial Sequence
  Description of Artificial Sequence: Synthetic peptide
GGGYSYGYDYGMDV

SEQ ID NO: 15836 - protein, 14 aa, Artificial Sequence
  Description of Artificial Sequence: Synthetic peptide
GGGYSYGYDYGMDV

SEQ ID NO: 15837 - protein, 14 aa, Artificial Sequence
  Description of Artificial Sequence: Synthetic peptide
GGGYSYGYDYGMDV

SEQ ID NO: 15838 - protein, 14 aa, Artificial Sequence
  Description of Artificial Sequence: Synthetic peptide
GGGYSYGYDYGMDV

SEQ ID NO: 15839 - protein, 14 aa, Artificial Sequence
  Description of Artificial Sequence: Synthetic peptide
GGGYSYGYDYGMDV

SEQ ID NO: 15840 - protein, 14 aa, Artificial Sequence
  Description of Artificial Sequence: Synthetic peptide
GGGYSYGYDYGMDV

SEQ ID NO: 15841 - protein, 16 aa, Artificial Sequence
  Description of Artificial Sequence: Synthetic peptide
GYSSGWYYYYYYGMDV

SEQ ID NO: 15842 - protein, 17 aa, Artificial Sequence
  Description of Artificial Sequence: Synthetic peptide
DGGSGWFPKLLHYGLDV

SEQ ID NO: 15843 - protein, 17 aa, Artificial Sequence
  Description of Artificial Sequence: Synthetic peptide
DGGSGWFPKLLHYGLDV

SEQ ID NO: 15844 - protein, 17 aa, Artificial Sequence
  Description of Artificial Sequence: Synthetic peptide
DGGSGWFPKLLHYGLDV

SEQ ID NO: 15845 - protein, 17 aa, Artificial Sequence
  Description of Artificial Sequence: Synthetic peptide
DGGSGWFPKLLHYGLDV

SEQ ID NO: 15846 - protein, 12 aa, Artificial Sequence
  Description of Artificial Sequence: Synthetic peptide
LTGYYYYYGMDV

SEQ ID NO: 15847 - protein, 12 aa, Artificial Sequence
  Description of Artificial Sequence: Synthetic peptide
LVTPDYYYGMDV

SEQ ID NO: 15848 - protein, 16 aa, Artificial Sequence
  Description of Artificial Sequence: Synthetic peptide
QGGIAAAYYYYDGMDV

SEQ ID NO: 15849 - protein, 15 aa, Artificial Sequence
  Description of Artificial Sequence: Synthetic peptide
GEGISARYYYYGMDV

SEQ ID NO: 15850 - protein, 15 aa, Artificial Sequence
  Description of Artificial Sequence: Synthetic peptide
VDTAMVYYYYYGMDV

SEQ ID NO: 15851 - protein, 12 aa, Artificial Sequence
  Description of Artificial Sequence: Synthetic peptide
VMTPDYYYDMDV

SEQ ID NO: 15852 - protein, 12 aa, Artificial Sequence
  Description of Artificial Sequence: Synthetic peptide
VMTPDYYYDMDV

SEQ ID NO: 15853 - protein, 12 aa, Artificial Sequence
  Description of Artificial Sequence: Synthetic peptide
VMTPDYYYDMDV

SEQ ID NO: 15854 - protein, 9 aa, Artificial Sequence
  Description of Artificial Sequence: Synthetic peptide
VLLWFGELL

SEQ ID NO: 15855 - protein, 9 aa, Artificial Sequence
  Description of Artificial Sequence: Synthetic peptide
YYYYYGMDV

SEQ ID NO: 15856 - protein, 16 aa, Artificial Sequence
  Description of Artificial Sequence: Synthetic peptide
DKLWFGKLNYYYGMDV

SEQ ID NO: 15857 - protein, 16 aa, Artificial Sequence
  Description of Artificial Sequence: Synthetic peptide
DLLWFGKLNYYYGMDV

SEQ ID NO: 15858 - protein, 16 aa, Artificial Sequence
  Description of Artificial Sequence: Synthetic peptide
DRLWFGVLNYYYGMDV

SEQ ID NO: 15859 - protein, 16 aa, Artificial Sequence
  Description of Artificial Sequence: Synthetic peptide
DRLWFGVLNYYYGMDV

SEQ ID NO: 15860 - protein, 16 aa, Artificial Sequence
  Description of Artificial Sequence: Synthetic peptide
DQLWFGVLNYYYGMDV

SEQ ID NO: 15861 - protein, 16 aa, Artificial Sequence
  Description of Artificial Sequence: Synthetic peptide
DRLWFGVLNYYYGMDV

SEQ ID NO: 15862 - protein, 16 aa, Artificial Sequence
  Description of Artificial Sequence: Synthetic peptide
DQLWFGVLNYYYGMDV

SEQ ID NO: 15863 - protein, 16 aa, Artificial Sequence
  Description of Artificial Sequence: Synthetic peptide
DRLWFGVLNYYYGMDV

SEQ ID NO: 15864 - protein, 16 aa, Artificial Sequence
  Description of Artificial Sequence: Synthetic peptide
DRLWFGVLNYYYGMDV

SEQ ID NO: 15865 - protein, 16 aa, Artificial Sequence
  Description of Artificial Sequence: Synthetic peptide
DQLWFGVLNYYYGMDV

SEQ ID NO: 15866 - protein, 16 aa, Artificial Sequence
  Description of Artificial Sequence: Synthetic peptide
DQLWFGVLNYYYGMDV

SEQ ID NO: 15867 - protein, 16 aa, Artificial Sequence
  Description of Artificial Sequence: Synthetic peptide
DLLWFGKLNYYYGLDV

SEQ ID NO: 15868 - protein, 16 aa, Artificial Sequence
  Description of Artificial Sequence: Synthetic peptide
DLLWFGKLNYYYGLDV

SEQ ID NO: 15869 - protein, 16 aa, Artificial Sequence
  Description of Artificial Sequence: Synthetic peptide
DRLWFGVLNYYYGMDV

SEQ ID NO: 15870 - protein, 16 aa, Artificial Sequence
  Description of Artificial Sequence: Synthetic peptide
DRLWFGVLNYYYGMDV

SEQ ID NO: 15871 - protein, 16 aa, Artificial Sequence
  Description of Artificial Sequence: Synthetic peptide
DRLWFGVLNYYYGMDV

SEQ ID NO: 15872 - protein, 16 aa, Artificial Sequence
  Description of Artificial Sequence: Synthetic peptide
DRLWFGVLNYYYGMDV

SEQ ID NO: 15873 - protein, 16 aa, Artificial Sequence
  Description of Artificial Sequence: Synthetic peptide
DRLWFGVLNYYYGMDV

SEQ ID NO: 15874 - protein, 14 aa, Artificial Sequence
  Description of Artificial Sequence: Synthetic peptide
GTTGTYYYYYGMDV

SEQ ID NO: 15875 - protein, 12 aa, Artificial Sequence
  Description of Artificial Sequence: Synthetic peptide
MVTPDYYYDMDV

SEQ ID NO: 15876 - protein, 19 aa, Artificial Sequence
  Description of Artificial Sequence: Synthetic peptide
YYYGSGSYYNYYYYYGMDV

SEQ ID NO: 15877 - protein, 17 aa, Artificial Sequence
  Description of Artificial Sequence: Synthetic peptide
NYGSGSYGAYYYHGMDV

SEQ ID NO: 15878 - protein, 17 aa, Artificial Sequence
  Description of Artificial Sequence: Synthetic peptide
NYGSGSYGAYYYHGMDV

SEQ ID NO: 15879 - protein, 12 aa, Artificial Sequence
  Description of Artificial Sequence: Synthetic peptide
NWGYYYYYGMDV

SEQ ID NO: 15880 - protein, 12 aa, Artificial Sequence
  Description of Artificial Sequence: Synthetic peptide
GWGTYYYYGMDV

SEQ ID NO: 15881 - protein, 12 aa, Artificial Sequence
  Description of Artificial Sequence: Synthetic peptide
GWGRYYSYGMDV

SEQ ID NO: 15882 - protein, 12 aa, Artificial Sequence
  Description of Artificial Sequence: Synthetic peptide
GWGRFYSYGMDV

SEQ ID NO: 15883 - protein, 12 aa, Artificial Sequence
  Description of Artificial Sequence: Synthetic peptide
GWGTYYYYGMDV

SEQ ID NO: 15884 - protein, 12 aa, Artificial Sequence
  Description of Artificial Sequence: Synthetic peptide
GWGTYYYYGMDV

SEQ ID NO: 15885 - protein, 14 aa, Artificial Sequence
  Description of Artificial Sequence: Synthetic peptide
SIAARYYYYYGMDV

SEQ ID NO: 15886 - protein, 12 aa, Artificial Sequence
  Description of Artificial Sequence: Synthetic peptide
SKAARPDDGMDV

SEQ ID NO: 15887 - protein, 19 aa, Artificial Sequence
  Description of Artificial Sequence: Synthetic peptide
YYYGSGSYYNYYYYYGMDV

SEQ ID NO: 15888 - protein, 17 aa, Artificial Sequence
  Description of Artificial Sequence: Synthetic peptide
NYGSGSYGAYYYHGMDV

SEQ ID NO: 15889 - protein, 17 aa, Artificial Sequence
  Description of Artificial Sequence: Synthetic peptide
NYGSGSYGAYYYYGMDV

SEQ ID NO: 15890 - protein, 13 aa, Artificial Sequence
  Description of Artificial Sequence: Synthetic peptide
ITIFGVVIIYFDY

SEQ ID NO: 15891 - protein, 11 aa, Artificial Sequence
  Description of Artificial Sequence: Synthetic peptide
GIFGVITYFDY

SEQ ID NO: 15892 - protein, 11 aa, Artificial Sequence
  Description of Artificial Sequence: Synthetic peptide
GIFGVITYFDY

SEQ ID NO: 15893 - protein, 11 aa, Artificial Sequence
  Description of Artificial Sequence: Synthetic peptide
GIFGVITYFDY

SEQ ID NO: 15894 - protein, 11 aa, Artificial Sequence
  Description of Artificial Sequence: Synthetic peptide
GIFGVITYFDY

SEQ ID NO: 15895 - protein, 9 aa, Artificial Sequence
  Description of Artificial Sequence: Synthetic peptide
VLLWFGELL

SEQ ID NO: 15896 - protein, 9 aa, Artificial Sequence
  Description of Artificial Sequence: Synthetic peptide
YYYYYGMDV

SEQ ID NO: 15897 - protein, 16 aa, Artificial Sequence
  Description of Artificial Sequence: Synthetic peptide
EVLWFGKLNYYYGMDV

SEQ ID NO: 15898 - protein, 14 aa, Artificial Sequence
  Description of Artificial Sequence: Synthetic peptide
ITIFGVVIINWFDP

SEQ ID NO: 15899 - protein, 11 aa, Artificial Sequence
  Description of Artificial Sequence: Synthetic peptide
TIFGVVGWFDP

SEQ ID NO: 15900 - protein, 8 aa, Artificial Sequence
  Description of Artificial Sequence: Synthetic peptide
LLLNWFDP

SEQ ID NO: 15901 - protein, 13 aa, Artificial Sequence
  Description of Artificial Sequence: Synthetic peptide
RRYNWNYENWFDP

SEQ ID NO: 15902 - protein, 13 aa, Artificial Sequence
  Description of Artificial Sequence: Synthetic peptide
RRYNWNYENWFDP

SEQ ID NO: 15903 - protein, 13 aa, Artificial Sequence
  Description of Artificial Sequence: Synthetic peptide
RRYNWNYENWFDP

SEQ ID NO: 15904 - protein, 15 aa, Artificial Sequence
  Description of Artificial Sequence: Synthetic peptide
GIVGATYYYYYGMDV

SEQ ID NO: 15905 - protein, 15 aa, Artificial Sequence
  Description of Artificial Sequence: Synthetic peptide
GEGIAARYYYYGMDV

SEQ ID NO: 15906 - protein, 14 aa, Artificial Sequence
  Description of Artificial Sequence: Synthetic peptide
ITIFGVVIINWFDP

SEQ ID NO: 15907 - protein, 11 aa, Artificial Sequence
  Description of Artificial Sequence: Synthetic peptide
TIFGVVGWFDP

SEQ ID NO: 15908 - protein, 8 aa, Artificial Sequence
  Description of Artificial Sequence: Synthetic peptide
LLLNWFDP

SEQ ID NO: 15909 - protein, 13 aa, Artificial Sequence
  Description of Artificial Sequence: Synthetic peptide
RRYNWNYENWFDP

SEQ ID NO: 15910 - protein, 13 aa, Artificial Sequence
  Description of Artificial Sequence: Synthetic peptide
RRYNWNYENWFDP

SEQ ID NO: 15911 - protein, 13 aa, Artificial Sequence
  Description of Artificial Sequence: Synthetic peptide
RRYNWNYENWFDP

SEQ ID NO: 15912 - protein, 13 aa, Artificial Sequence
  Description of Artificial Sequence: Synthetic peptide
RRYNWNYENWFDP

SEQ ID NO: 15913 - protein, 13 aa, Artificial Sequence
  Description of Artificial Sequence: Synthetic peptide
RRYNWNYENWFDP

SEQ ID NO: 15914 - protein, 13 aa, Artificial Sequence
  Description of Artificial Sequence: Synthetic peptide
RRYNWNYENWFDP

SEQ ID NO: 15915 - protein, 13 aa, Artificial Sequence
  Description of Artificial Sequence: Synthetic peptide
RRYNWNYENWFDP

SEQ ID NO: 15916 - protein, 13 aa, Artificial Sequence
  Description of Artificial Sequence: Synthetic peptide
RRYNWNYENWFDP

SEQ ID NO: 15917 - protein, 13 aa, Artificial Sequence
  Description of Artificial Sequence: Synthetic peptide
RRYNWNYENWFDP

SEQ ID NO: 15918 - protein, 13 aa, Artificial Sequence
  Description of Artificial Sequence: Synthetic peptide
RRYNWNYENWFDP

SEQ ID NO: 15919 - protein, 11 aa, Artificial Sequence
  Description of Artificial Sequence: Synthetic peptide
LGYYYYYGMDV

SEQ ID NO: 15920 - protein, 12 aa, Artificial Sequence
  Description of Artificial Sequence: Synthetic peptide
TLTPDYYYDMDV

SEQ ID NO: 15921 - protein, 12 aa, Artificial Sequence
  Description of Artificial Sequence: Synthetic peptide
ALTPDYYYDMDV

SEQ ID NO: 15922 - protein, 18 aa, Artificial Sequence
  Description of Artificial Sequence: Synthetic peptide
ITMVRGVIIYYYYYGMDV

SEQ ID NO: 15923 - protein, 16 aa, Artificial Sequence
  Description of Artificial Sequence: Synthetic peptide
EKMWFGVLNYYYGMDV

SEQ ID NO: 15924 - protein, 16 aa, Artificial Sequence
  Description of Artificial Sequence: Synthetic peptide
EKMWFGVLNYYYGMDV

SEQ ID NO: 15925 - protein, 16 aa, Artificial Sequence
  Description of Artificial Sequence: Synthetic peptide
EKMWFGVLNYYYGMDV

SEQ ID NO: 15926 - protein, 16 aa, Artificial Sequence
  Description of Artificial Sequence: Synthetic peptide
EKMWFGVLNYYYGMDV

SEQ ID NO: 15927 - protein, 16 aa, Artificial Sequence
  Description of Artificial Sequence: Synthetic peptide
EKMWFGVLNYYYGMDV

SEQ ID NO: 15928 - protein, 16 aa, Artificial Sequence
  Description of Artificial Sequence: Synthetic peptide
EKMWFGVLNYYYGMDV

SEQ ID NO: 15929 - protein, 19 aa, Artificial Sequence
  Description of Artificial Sequence: Synthetic peptide
YYYGSGSYYNYYYYYGMDV

SEQ ID NO: 15930 - protein, 16 aa, Artificial Sequence
  Description of Artificial Sequence: Synthetic peptide
PSNSGSYYNYFSVMDV

SEQ ID NO: 15931 - protein, 16 aa, Artificial Sequence
  Description of Artificial Sequence: Synthetic peptide
PSNSGSYYNYFSVMDV

SEQ ID NO: 15932 - protein, 16 aa, Artificial Sequence
  Description of Artificial Sequence: Synthetic peptide
PSNSGSYYNYFSVMDV

SEQ ID NO: 15933 - protein, 16 aa, Artificial Sequence
  Description of Artificial Sequence: Synthetic peptide
PSYSGSYYNYFSVMDV

SEQ ID NO: 15934 - protein, 16 aa, Artificial Sequence
  Description of Artificial Sequence: Synthetic peptide
PSNSGSYYNYFSVMDV

SEQ ID NO: 15935 - protein, 16 aa, Artificial Sequence
  Description of Artificial Sequence: Synthetic peptide
PSNGGSYYNYFSVMDV

SEQ ID NO: 15936 - protein, 16 aa, Artificial Sequence
  Description of Artificial Sequence: Synthetic peptide
PSYSGSYYNYFSVMDV

SEQ ID NO: 15937 - protein, 16 aa, Artificial Sequence
  Description of Artificial Sequence: Synthetic peptide
PSYSGSYYNYFSVMDV

SEQ ID NO: 15938 - protein, 16 aa, Artificial Sequence
  Description of Artificial Sequence: Synthetic peptide
PSNSGSYYNYFSVMDV

SEQ ID NO: 15939 - protein, 16 aa, Artificial Sequence
  Description of Artificial Sequence: Synthetic peptide
PSYSGSYYNYFSVMDV

SEQ ID NO: 15940 - protein, 16 aa, Artificial Sequence
  Description of Artificial Sequence: Synthetic peptide
PSYSGSYYNYFSVMDV

SEQ ID NO: 15941 - protein, 16 aa, Artificial Sequence
  Description of Artificial Sequence: Synthetic peptide
PSYSGSYYNYFSVMDV

SEQ ID NO: 15942 - protein, 16 aa, Artificial Sequence
  Description of Artificial Sequence: Synthetic peptide
PSNSGSYYNYFSVMDV

SEQ ID NO: 15943 - protein, 16 aa, Artificial Sequence
  Description of Artificial Sequence: Synthetic peptide
PSYSGSYYNYFSVMDV

SEQ ID NO: 15944 - protein, 16 aa, Artificial Sequence
  Description of Artificial Sequence: Synthetic peptide
PSYSGSYYNYFSVMDV

SEQ ID NO: 15945 - protein, 16 aa, Artificial Sequence
  Description of Artificial Sequence: Synthetic peptide
PSYSGSYYNYFSVMDV

SEQ ID NO: 15946 - protein, 16 aa, Artificial Sequence
  Description of Artificial Sequence: Synthetic peptide
PSYSGSYYNYFSVMDV

SEQ ID NO: 15947 - protein, 16 aa, Artificial Sequence
  Description of Artificial Sequence: Synthetic peptide
PSYSGSYYNYFSVMDV

SEQ ID NO: 15948 - protein, 16 aa, Artificial Sequence
  Description of Artificial Sequence: Synthetic peptide
PSYSGSYYNYFSVMDV

SEQ ID NO: 15949 - protein, 16 aa, Artificial Sequence
  Description of Artificial Sequence: Synthetic peptide
PSYSGSYYNYFSVMDV

SEQ ID NO: 15950 - protein, 16 aa, Artificial Sequence
  Description of Artificial Sequence: Synthetic peptide
PSYSGSYYNYFSVMDV

SEQ ID NO: 15951 - protein, 16 aa, Artificial Sequence
  Description of Artificial Sequence: Synthetic peptide
PSYSGSYYNYFSVMDV

SEQ ID NO: 15952 - protein, 16 aa, Artificial Sequence
  Description of Artificial Sequence: Synthetic peptide
PSYSGSYYNYFSVMDV

SEQ ID NO: 15953 - protein, 18 aa, Artificial Sequence
  Description of Artificial Sequence: Synthetic peptide
ITMVRGVIIYYYYYGMDV

SEQ ID NO: 15954 - protein, 16 aa, Artificial Sequence
  Description of Artificial Sequence: Synthetic peptide
EKMWFGVLNYYYGMDV

SEQ ID NO: 15955 - protein, 16 aa, Artificial Sequence
  Description of Artificial Sequence: Synthetic peptide
EKMWFGVLNYYYGMDV

SEQ ID NO: 15956 - protein, 16 aa, Artificial Sequence
  Description of Artificial Sequence: Synthetic peptide
EKMWFGVLNYYYGMDV

SEQ ID NO: 15957 - protein, 10 aa, Artificial Sequence
  Description of Artificial Sequence: Synthetic peptide
GIAVAGYFDY

SEQ ID NO: 15958 - protein, 10 aa, Artificial Sequence
  Description of Artificial Sequence: Synthetic peptide
GKGVHLGFDY

SEQ ID NO: 15959 - protein, 10 aa, Artificial Sequence
  Description of Artificial Sequence: Synthetic peptide
GKGVHLNFDY

SEQ ID NO: 15960 - protein, 10 aa, Artificial Sequence
  Description of Artificial Sequence: Synthetic peptide
GKGVHLGFDY

SEQ ID NO: 15961 - protein, 10 aa, Artificial Sequence
  Description of Artificial Sequence: Synthetic peptide
GKGVHLGFDY

SEQ ID NO: 15962 - protein, 10 aa, Artificial Sequence
  Description of Artificial Sequence: Synthetic peptide
GKGVHLGFDY

SEQ ID NO: 15963 - protein, 10 aa, Artificial Sequence
  Description of Artificial Sequence: Synthetic peptide
GKGVHLGFDY

SEQ ID NO: 15964 - protein, 10 aa, Artificial Sequence
  Description of Artificial Sequence: Synthetic peptide
GKGVHLGFDY

SEQ ID NO: 15965 - protein, 10 aa, Artificial Sequence
  Description of Artificial Sequence: Synthetic peptide
GKGVHLGFDY

SEQ ID NO: 15966 - protein, 10 aa, Artificial Sequence
  Description of Artificial Sequence: Synthetic peptide
GKGVHLGFDY

SEQ ID NO: 15967 - protein, 10 aa, Artificial Sequence
  Description of Artificial Sequence: Synthetic peptide
GKGVHLNFDY

SEQ ID NO: 15968 - protein, 10 aa, Artificial Sequence
  Description of Artificial Sequence: Synthetic peptide
GKGVHLGFDY

SEQ ID NO: 15969 - protein, 10 aa, Artificial Sequence
  Description of Artificial Sequence: Synthetic peptide
GKGVHLGFDY

SEQ ID NO: 15970 - protein, 10 aa, Artificial Sequence
  Description of Artificial Sequence: Synthetic peptide
GKGVHLGFDY

SEQ ID NO: 15971 - protein, 10 aa, Artificial Sequence
  Description of Artificial Sequence: Synthetic peptide
GKGVHLNFDY

SEQ ID NO: 15972 - protein, 10 aa, Artificial Sequence
  Description of Artificial Sequence: Synthetic peptide
GKGVHLGFDY

SEQ ID NO: 15973 - protein, 10 aa, Artificial Sequence
  Description of Artificial Sequence: Synthetic peptide
GKGVHLGFDY

SEQ ID NO: 15974 - protein, 10 aa, Artificial Sequence
  Description of Artificial Sequence: Synthetic peptide
GKGVHLNFDY

SEQ ID NO: 15975 - protein, 10 aa, Artificial Sequence
  Description of Artificial Sequence: Synthetic peptide
GKGVHLGFDY

SEQ ID NO: 15976 - protein, 10 aa, Artificial Sequence
  Description of Artificial Sequence: Synthetic peptide
GKGVHLNFDY

SEQ ID NO: 15977 - protein, 10 aa, Artificial Sequence
  Description of Artificial Sequence: Synthetic peptide
GKGVHLNFDY

SEQ ID NO: 15978 - protein, 10 aa, Artificial Sequence
  Description of Artificial Sequence: Synthetic peptide
GKGVHLGFDY

SEQ ID NO: 15979 - protein, 10 aa, Artificial Sequence
  Description of Artificial Sequence: Synthetic peptide
GKGVHLGFDY

SEQ ID NO: 15980 - protein, 10 aa, Artificial Sequence
  Description of Artificial Sequence: Synthetic peptide
GKGVHLGFDY

SEQ ID NO: 15981 - protein, 10 aa, Artificial Sequence
  Description of Artificial Sequence: Synthetic peptide
GKGVHLGFDY

SEQ ID NO: 15982 - protein, 10 aa, Artificial Sequence
  Description of Artificial Sequence: Synthetic peptide
GKGVHLNFDY

SEQ ID NO: 15983 - protein, 10 aa, Artificial Sequence
  Description of Artificial Sequence: Synthetic peptide
GKGVHLNFDY

SEQ ID NO: 15984 - protein, 10 aa, Artificial Sequence
  Description of Artificial Sequence: Synthetic peptide
GKGVHLGFDY

SEQ ID NO: 15985 - protein, 10 aa, Artificial Sequence
  Description of Artificial Sequence: Synthetic peptide
GKGVHLGFDY

SEQ ID NO: 15986 - protein, 10 aa, Artificial Sequence
  Description of Artificial Sequence: Synthetic peptide
GKGVHLGFDY

SEQ ID NO: 15987 - protein, 10 aa, Artificial Sequence
  Description of Artificial Sequence: Synthetic peptide
GKGVHLGFDY

SEQ ID NO: 15988 - protein, 10 aa, Artificial Sequence
  Description of Artificial Sequence: Synthetic peptide
GKGVHLGFDY

SEQ ID NO: 15989 - protein, 10 aa, Artificial Sequence
  Description of Artificial Sequence: Synthetic peptide
GKGVHLGFDY

SEQ ID NO: 15990 - protein, 10 aa, Artificial Sequence
  Description of Artificial Sequence: Synthetic peptide
GKGVHLGFDY

SEQ ID NO: 15991 - protein, 10 aa, Artificial Sequence
  Description of Artificial Sequence: Synthetic peptide
GKGVHLGFDY

SEQ ID NO: 15992 - protein, 10 aa, Artificial Sequence
  Description of Artificial Sequence: Synthetic peptide
GKGVHLGFDY

SEQ ID NO: 15993 - protein, 10 aa, Artificial Sequence
  Description of Artificial Sequence: Synthetic peptide
GKGVHLNFDY

SEQ ID NO: 15994 - protein, 10 aa, Artificial Sequence
  Description of Artificial Sequence: Synthetic peptide
GKGVHLGFDY

SEQ ID NO: 15995 - protein, 10 aa, Artificial Sequence
  Description of Artificial Sequence: Synthetic peptide
GKGVHLGFDY

SEQ ID NO: 15996 - protein, 10 aa, Artificial Sequence
  Description of Artificial Sequence: Synthetic peptide
GKGVHLGFDY

SEQ ID NO: 15997 - protein, 10 aa, Artificial Sequence
  Description of Artificial Sequence: Synthetic peptide
GKGVHLNFDY

SEQ ID NO: 15998 - protein, 10 aa, Artificial Sequence
  Description of Artificial Sequence: Synthetic peptide
GKGVHLNFDY

SEQ ID NO: 15999 - protein, 10 aa, Artificial Sequence
  Description of Artificial Sequence: Synthetic peptide
GKGVHLGFDY

SEQ ID NO: 16000 - protein, 10 aa, Artificial Sequence
  Description of Artificial Sequence: Synthetic peptide
GKGVHLGFDY

SEQ ID NO: 16001 - protein, 10 aa, Artificial Sequence
  Description of Artificial Sequence: Synthetic peptide
GKGVHLGFDY

SEQ ID NO: 16002 - protein, 10 aa, Artificial Sequence
  Description of Artificial Sequence: Synthetic peptide
GKGVHLGFDY

SEQ ID NO: 16003 - protein, 10 aa, Artificial Sequence
  Description of Artificial Sequence: Synthetic peptide
GKGVHLGFDY

SEQ ID NO: 16004 - protein, 10 aa, Artificial Sequence
  Description of Artificial Sequence: Synthetic peptide
GKGVHLGFDY

SEQ ID NO: 16005 - protein, 10 aa, Artificial Sequence
  Description of Artificial Sequence: Synthetic peptide
GKGVHLGFDY

SEQ ID NO: 16006 - protein, 10 aa, Artificial Sequence
  Description of Artificial Sequence: Synthetic peptide
GKGVHLGFDY

SEQ ID NO: 16007 - protein, 10 aa, Artificial Sequence
  Description of Artificial Sequence: Synthetic peptide
GKGVHLGFDY

SEQ ID NO: 16008 - protein, 10 aa, Artificial Sequence
  Description of Artificial Sequence: Synthetic peptide
GKGVHLGFDY

SEQ ID NO: 16009 - protein, 10 aa, Artificial Sequence
  Description of Artificial Sequence: Synthetic peptide
GKGVHLGFDY

SEQ ID NO: 16010 - protein, 10 aa, Artificial Sequence
  Description of Artificial Sequence: Synthetic peptide
GKGVHLGFDY

SEQ ID NO: 16011 - protein, 10 aa, Artificial Sequence
  Description of Artificial Sequence: Synthetic peptide
GKGVHLGFDY

SEQ ID NO: 16012 - protein, 10 aa, Artificial Sequence
  Description of Artificial Sequence: Synthetic peptide
GKGVHLGFDY

SEQ ID NO: 16013 - protein, 10 aa, Artificial Sequence
  Description of Artificial Sequence: Synthetic peptide
GKGVHLGFDY

SEQ ID NO: 16014 - protein, 10 aa, Artificial Sequence
  Description of Artificial Sequence: Synthetic peptide
GKGVHLGFDY

SEQ ID NO: 16015 - protein, 12 aa, Artificial Sequence
  Description of Artificial Sequence: Synthetic peptide
GIAVAGAEYFQH

SEQ ID NO: 16016 - protein, 10 aa, Artificial Sequence
  Description of Artificial Sequence: Synthetic peptide
GKGVHLGFDH

SEQ ID NO: 16017 - protein, 9 aa, Artificial Sequence
  Description of Artificial Sequence: Synthetic peptide
VQLERYFDY

SEQ ID NO: 16018 - protein, 7 aa, Artificial Sequence
  Description of Artificial Sequence: Synthetic peptide
GQLLTGY

SEQ ID NO: 16019 - protein, 7 aa, Artificial Sequence
  Description of Artificial Sequence: Synthetic peptide
GQLLTGY

SEQ ID NO: 16020 - protein, 7 aa, Artificial Sequence
  Description of Artificial Sequence: Synthetic peptide
GQLLTGY

SEQ ID NO: 16021 - protein, 10 aa, Artificial Sequence
  Description of Artificial Sequence: Synthetic peptide
GIAAAGYFDY

SEQ ID NO: 16022 - protein, 7 aa, Artificial Sequence
  Description of Artificial Sequence: Synthetic peptide
GRATFDY

SEQ ID NO: 16023 - protein, 7 aa, Artificial Sequence
  Description of Artificial Sequence: Synthetic peptide
GRATFDY

SEQ ID NO: 16024 - protein, 9 aa, Artificial Sequence
  Description of Artificial Sequence: Synthetic peptide
YNWNDYFDY

SEQ ID NO: 16025 - protein, 8 aa, Artificial Sequence
  Description of Artificial Sequence: Synthetic peptide
YNYGHFDY

SEQ ID NO: 16026 - protein, 8 aa, Artificial Sequence
  Description of Artificial Sequence: Synthetic peptide
YNYGHFDY

SEQ ID NO: 16027 - protein, 10 aa, Artificial Sequence
  Description of Artificial Sequence: Synthetic peptide
FGQGTKLEIK

SEQ ID NO: 16028 - protein, 10 aa, Artificial Sequence
  Description of Artificial Sequence: Synthetic peptide
FGGGTKLELK

SEQ ID NO: 16029 - protein, 10 aa, Artificial Sequence
  Description of Artificial Sequence: Synthetic peptide
FGQGTKLEIK

SEQ ID NO: 16030 - protein, 10 aa, Artificial Sequence
  Description of Artificial Sequence: Synthetic peptide
FGQGTKLEIK

SEQ ID NO: 16031 - protein, 10 aa, Artificial Sequence
  Description of Artificial Sequence: Synthetic peptide
FGQGTKLEIK

SEQ ID NO: 16032 - protein, 10 aa, Artificial Sequence
  Description of Artificial Sequence: Synthetic peptide
FGSGTKLEIK

SEQ ID NO: 16033 - protein, 10 aa, Artificial Sequence
  Description of Artificial Sequence: Synthetic peptide
FGQGTKLEIK

SEQ ID NO: 16034 - protein, 10 aa, Artificial Sequence
  Description of Artificial Sequence: Synthetic peptide
FGAGTKLELK

SEQ ID NO: 16035 - protein, 10 aa, Artificial Sequence
  Description of Artificial Sequence: Synthetic peptide
FGQGTRLEIK

SEQ ID NO: 16036 - protein, 10 aa, Artificial Sequence
  Description of Artificial Sequence: Synthetic peptide
FGQGTRLEIK

SEQ ID NO: 16037 - protein, 10 aa, Artificial Sequence
  Description of Artificial Sequence: Synthetic peptide
FGQGTRLEIK

SEQ ID NO: 16038 - protein, 10 aa, Artificial Sequence
  Description of Artificial Sequence: Synthetic peptide
FGQGTKLEIK

SEQ ID NO: 16039 - protein, 10 aa, Artificial Sequence
  Description of Artificial Sequence: Synthetic peptide
FGPGTKLEIK

SEQ ID NO: 16040 - protein, 10 aa, Artificial Sequence
  Description of Artificial Sequence: Synthetic peptide
FGQGTKLEIK

SEQ ID NO: 16041 - protein, 10 aa, Artificial Sequence
  Description of Artificial Sequence: Synthetic peptide
FGQGTKLEIK

SEQ ID NO: 16042 - protein, 10 aa, Artificial Sequence
  Description of Artificial Sequence: Synthetic peptide
FGQGTKLDIK

SEQ ID NO: 16043 - protein, 10 aa, Artificial Sequence
  Description of Artificial Sequence: Synthetic peptide
FGQGTKLEIK

SEQ ID NO: 16044 - protein, 10 aa, Artificial Sequence
  Description of Artificial Sequence: Synthetic peptide
FGQGTKLEIK

SEQ ID NO: 16045 - protein, 10 aa, Artificial Sequence
  Description of Artificial Sequence: Synthetic peptide
FGQGTKLEIK

SEQ ID NO: 16046 - protein, 10 aa, Artificial Sequence
  Description of Artificial Sequence: Synthetic peptide
FGQGTKLEIK

SEQ ID NO: 16047 - protein, 10 aa, Artificial Sequence
  Description of Artificial Sequence: Synthetic peptide
FGQGTKVEIK

SEQ ID NO: 16048 - protein, 10 aa, Artificial Sequence
  Description of Artificial Sequence: Synthetic peptide
FGQGTKVEIK

SEQ ID NO: 16049 - protein, 10 aa, Artificial Sequence
  Description of Artificial Sequence: Synthetic peptide
FGQGTKVEIK

SEQ ID NO: 16050 - protein, 10 aa, Artificial Sequence
  Description of Artificial Sequence: Synthetic peptide
FGQGTKVEIK

SEQ ID NO: 16051 - protein, 10 aa, Artificial Sequence
  Description of Artificial Sequence: Synthetic peptide
FGQGTKVEIK

SEQ ID NO: 16052 - protein, 10 aa, Artificial Sequence
  Description of Artificial Sequence: Synthetic peptide
FGQGTKVEIK

SEQ ID NO: 16053 - protein, 10 aa, Artificial Sequence
  Description of Artificial Sequence: Synthetic peptide
FGQGTKVEIK

SEQ ID NO: 16054 - protein, 10 aa, Artificial Sequence
  Description of Artificial Sequence: Synthetic peptide
FGQGTKVEIK

SEQ ID NO: 16055 - protein, 10 aa, Artificial Sequence
  Description of Artificial Sequence: Synthetic peptide
FGPGTKVDIK

SEQ ID NO: 16056 - protein, 10 aa, Artificial Sequence
  Description of Artificial Sequence: Synthetic peptide
FGPGTKVDIK

SEQ ID NO: 16057 - protein, 10 aa, Artificial Sequence
  Description of Artificial Sequence: Synthetic peptide
FGPGTKVEIK

SEQ ID NO: 16058 - protein, 10 aa, Artificial Sequence
  Description of Artificial Sequence: Synthetic peptide
FGGGTKVEIK

SEQ ID NO: 16059 - protein, 10 aa, Artificial Sequence
  Description of Artificial Sequence: Synthetic peptide
FGGGTKLEIK

SEQ ID NO: 16060 - protein, 10 aa, Artificial Sequence
  Description of Artificial Sequence: Synthetic peptide
FGGGTKLEIK

SEQ ID NO: 16061 - protein, 10 aa, Artificial Sequence
  Description of Artificial Sequence: Synthetic peptide
FGGGTKVDIK

SEQ ID NO: 16062 - protein, 10 aa, Artificial Sequence
  Description of Artificial Sequence: Synthetic peptide
FGGGTKLEIK

SEQ ID NO: 16063 - protein, 10 aa, Artificial Sequence
  Description of Artificial Sequence: Synthetic peptide
FGGGTKVDIK

SEQ ID NO: 16064 - protein, 10 aa, Artificial Sequence
  Description of Artificial Sequence: Synthetic peptide
FGPGTKVDIK

SEQ ID NO: 16065 - protein, 10 aa, Artificial Sequence
  Description of Artificial Sequence: Synthetic peptide
FGPGTKVEIK

SEQ ID NO: 16066 - protein, 10 aa, Artificial Sequence
  Description of Artificial Sequence: Synthetic peptide
FGPGTKVEIK

SEQ ID NO: 16067 - protein, 10 aa, Artificial Sequence
  Description of Artificial Sequence: Synthetic peptide
FGPGTKVEIK

SEQ ID NO: 16068 - protein, 10 aa, Artificial Sequence
  Description of Artificial Sequence: Synthetic peptide
FGPGTKVDIK

SEQ ID NO: 16069 - protein, 10 aa, Artificial Sequence
  Description of Artificial Sequence: Synthetic peptide
FGPGTKVDIK

SEQ ID NO: 16070 - protein, 10 aa, Artificial Sequence
  Description of Artificial Sequence: Synthetic peptide
FGPGTKVEIK

SEQ ID NO: 16071 - protein, 10 aa, Artificial Sequence
  Description of Artificial Sequence: Synthetic peptide
FGPGTKVEIK

SEQ ID NO: 16072 - protein, 10 aa, Artificial Sequence
  Description of Artificial Sequence: Synthetic peptide
FGPGTKVEIK

SEQ ID NO: 16073 - protein, 10 aa, Artificial Sequence
  Description of Artificial Sequence: Synthetic peptide
FGPGTKVEIK

SEQ ID NO: 16074 - protein, 10 aa, Artificial Sequence
  Description of Artificial Sequence: Synthetic peptide
FGPGTKVEIK

SEQ ID NO: 16075 - protein, 10 aa, Artificial Sequence
  Description of Artificial Sequence: Synthetic peptide
FGPGTKVEIK

SEQ ID NO: 16076 - protein, 10 aa, Artificial Sequence
  Description of Artificial Sequence: Synthetic peptide
FGQGTKVEIK

SEQ ID NO: 16077 - protein, 10 aa, Artificial Sequence
  Description of Artificial Sequence: Synthetic peptide
FGQGTKVEIK

SEQ ID NO: 16078 - protein, 10 aa, Artificial Sequence
  Description of Artificial Sequence: Synthetic peptide
FGQGTKVEIK

SEQ ID NO: 16079 - protein, 10 aa, Artificial Sequence
  Description of Artificial Sequence: Synthetic peptide
FGGGTKVEIK

SEQ ID NO: 16080 - protein, 10 aa, Artificial Sequence
  Description of Artificial Sequence: Synthetic peptide
FGGGTKVEIK

SEQ ID NO: 16081 - protein, 10 aa, Artificial Sequence
  Description of Artificial Sequence: Synthetic peptide
FGGGTKVDIK

SEQ ID NO: 16082 - protein, 10 aa, Artificial Sequence
  Description of Artificial Sequence: Synthetic peptide
FGGGTKLEIK

SEQ ID NO: 16083 - protein, 10 aa, Artificial Sequence
  Description of Artificial Sequence: Synthetic peptide
FGGGTKVEIK

SEQ ID NO: 16084 - protein, 10 aa, Artificial Sequence
  Description of Artificial Sequence: Synthetic peptide
FGGGTKVEIK

SEQ ID NO: 16085 - protein, 10 aa, Artificial Sequence
  Description of Artificial Sequence: Synthetic peptide
FGQGTKLEIK

SEQ ID NO: 16086 - protein, 10 aa, Artificial Sequence
  Description of Artificial Sequence: Synthetic peptide
FGQGTKLEIK

SEQ ID NO: 16087 - protein, 10 aa, Artificial Sequence
  Description of Artificial Sequence: Synthetic peptide
FGGGTKLEIK

SEQ ID NO: 16088 - protein, 10 aa, Artificial Sequence
  Description of Artificial Sequence: Synthetic peptide
FGQGTKVEIK

SEQ ID NO: 16089 - protein, 10 aa, Artificial Sequence
  Description of Artificial Sequence: Synthetic peptide
FGQGTKVDIK

SEQ ID NO: 16090 - protein, 10 aa, Artificial Sequence
  Description of Artificial Sequence: Synthetic peptide
FGQGTKVEIK

SEQ ID NO: 16091 - protein, 10 aa, Artificial Sequence
  Description of Artificial Sequence: Synthetic peptide
FGQGTKVDIK

SEQ ID NO: 16092 - protein, 10 aa, Artificial Sequence
  Description of Artificial Sequence: Synthetic peptide
FGQGTKVDIK

SEQ ID NO: 16093 - protein, 10 aa, Artificial Sequence
  Description of Artificial Sequence: Synthetic peptide
FGPGTKVEIK

SEQ ID NO: 16094 - protein, 10 aa, Artificial Sequence
  Description of Artificial Sequence: Synthetic peptide
FGPGTKVEIK

SEQ ID NO: 16095 - protein, 10 aa, Artificial Sequence
  Description of Artificial Sequence: Synthetic peptide
FGPGTKVEIK

SEQ ID NO: 16096 - protein, 10 aa, Artificial Sequence
  Description of Artificial Sequence: Synthetic peptide
FGQGTRLEIK

SEQ ID NO: 16097 - protein, 10 aa, Artificial Sequence
  Description of Artificial Sequence: Synthetic peptide
FGQGTRLEIK

SEQ ID NO: 16098 - protein, 10 aa, Artificial Sequence
  Description of Artificial Sequence: Synthetic peptide
FGQGTRLEIK

SEQ ID NO: 16099 - protein, 10 aa, Artificial Sequence
  Description of Artificial Sequence: Synthetic peptide
FGQGTKVEIK

SEQ ID NO: 16100 - protein, 10 aa, Artificial Sequence
  Description of Artificial Sequence: Synthetic peptide
FGQGTKVDIK

SEQ ID NO: 16101 - protein, 10 aa, Artificial Sequence
  Description of Artificial Sequence: Synthetic peptide
FGQGTKVDIK

SEQ ID NO: 16102 - protein, 10 aa, Artificial Sequence
  Description of Artificial Sequence: Synthetic peptide
FGQGTKVEIK

SEQ ID NO: 16103 - protein, 10 aa, Artificial Sequence
  Description of Artificial Sequence: Synthetic peptide
FGQGTKVEIK

SEQ ID NO: 16104 - protein, 10 aa, Artificial Sequence
  Description of Artificial Sequence: Synthetic peptide
FGQGTKVEIK

SEQ ID NO: 16105 - protein, 10 aa, Artificial Sequence
  Description of Artificial Sequence: Synthetic peptide
FGQGTKVEIK

SEQ ID NO: 16106 - protein, 10 aa, Artificial Sequence
  Description of Artificial Sequence: Synthetic peptide
FGQGTKVDIK

SEQ ID NO: 16107 - protein, 10 aa, Artificial Sequence
  Description of Artificial Sequence: Synthetic peptide
FGQGTKVEIK

SEQ ID NO: 16108 - protein, 10 aa, Artificial Sequence
  Description of Artificial Sequence: Synthetic peptide
FGQGTKVDIK

SEQ ID NO: 16109 - protein, 10 aa, Artificial Sequence
  Description of Artificial Sequence: Synthetic peptide
FGGGTKVEIK

SEQ ID NO: 16110 - protein, 10 aa, Artificial Sequence
  Description of Artificial Sequence: Synthetic peptide
FGGGTKLEIK

SEQ ID NO: 16111 - protein, 10 aa, Artificial Sequence
  Description of Artificial Sequence: Synthetic peptide
FGGGTKLEIK

SEQ ID NO: 16112 - protein, 10 aa, Artificial Sequence
  Description of Artificial Sequence: Synthetic peptide
FGGGTKVDIK

SEQ ID NO: 16113 - protein, 10 aa, Artificial Sequence
  Description of Artificial Sequence: Synthetic peptide
FGPGTKVDIK

SEQ ID NO: 16114 - protein, 10 aa, Artificial Sequence
  Description of Artificial Sequence: Synthetic peptide
FGPGTKVEIK

SEQ ID NO: 16115 - protein, 10 aa, Artificial Sequence
  Description of Artificial Sequence: Synthetic peptide
FGPGTKVDIK

SEQ ID NO: 16116 - protein, 10 aa, Artificial Sequence
  Description of Artificial Sequence: Synthetic peptide
FGPGTKVEIK

SEQ ID NO: 16117 - protein, 10 aa, Artificial Sequence
  Description of Artificial Sequence: Synthetic peptide
FGPGTKVDIK

SEQ ID NO: 16118 - protein, 10 aa, Artificial Sequence
  Description of Artificial Sequence: Synthetic peptide
FGPGTKVEIK

SEQ ID NO: 16119 - protein, 10 aa, Artificial Sequence
  Description of Artificial Sequence: Synthetic peptide
FGPGTKVEIK

SEQ ID NO: 16120 - protein, 10 aa, Artificial Sequence
  Description of Artificial Sequence: Synthetic peptide
FGPGTKVDIK

SEQ ID NO: 16121 - protein, 10 aa, Artificial Sequence
  Description of Artificial Sequence: Synthetic peptide
FGPGTKVEIK

SEQ ID NO: 16122 - protein, 10 aa, Artificial Sequence
  Description of Artificial Sequence: Synthetic peptide
FGQGTKVEIK

SEQ ID NO: 16123 - protein, 10 aa, Artificial Sequence
  Description of Artificial Sequence: Synthetic peptide
FGQGTKVEIK

SEQ ID NO: 16124 - protein, 10 aa, Artificial Sequence
  Description of Artificial Sequence: Synthetic peptide
FGQGTRLEIK

SEQ ID NO: 16125 - protein, 10 aa, Artificial Sequence
  Description of Artificial Sequence: Synthetic peptide
FGQGTRLEIK

SEQ ID NO: 16126 - protein, 10 aa, Artificial Sequence
  Description of Artificial Sequence: Synthetic peptide
FGQGTKVEIK

SEQ ID NO: 16127 - protein, 10 aa, Artificial Sequence
  Description of Artificial Sequence: Synthetic peptide
FGQGTKVEIK

SEQ ID NO: 16128 - protein, 10 aa, Artificial Sequence
  Description of Artificial Sequence: Synthetic peptide
FGQGTKVEIK

SEQ ID NO: 16129 - protein, 10 aa, Artificial Sequence
  Description of Artificial Sequence: Synthetic peptide
FGQGTKVDIK

SEQ ID NO: 16130 - protein, 10 aa, Artificial Sequence
  Description of Artificial Sequence: Synthetic peptide
FGQGTKVEIK

SEQ ID NO: 16131 - protein, 10 aa, Artificial Sequence
  Description of Artificial Sequence: Synthetic peptide
FGQGTKVEIK

SEQ ID NO: 16132 - protein, 10 aa, Artificial Sequence
  Description of Artificial Sequence: Synthetic peptide
FGGGTKVEIK

SEQ ID NO: 16133 - protein, 10 aa, Artificial Sequence
  Description of Artificial Sequence: Synthetic peptide
FGGGTKVEIK

SEQ ID NO: 16134 - protein, 10 aa, Artificial Sequence
  Description of Artificial Sequence: Synthetic peptide
FGGGTKVEIK

SEQ ID NO: 16135 - protein, 10 aa, Artificial Sequence
  Description of Artificial Sequence: Synthetic peptide
FGGGTKVDIK

SEQ ID NO: 16136 - protein, 10 aa, Artificial Sequence
  Description of Artificial Sequence: Synthetic peptide
FGGGTKVEIK

SEQ ID NO: 16137 - protein, 10 aa, Artificial Sequence
  Description of Artificial Sequence: Synthetic peptide
FGQGTKLEIK

SEQ ID NO: 16138 - protein, 10 aa, Artificial Sequence
  Description of Artificial Sequence: Synthetic peptide
FGPGTKLEIK

SEQ ID NO: 16139 - protein, 10 aa, Artificial Sequence
  Description of Artificial Sequence: Synthetic peptide
FGPGTKLEIK

SEQ ID NO: 16140 - protein, 10 aa, Artificial Sequence
  Description of Artificial Sequence: Synthetic peptide
FGPGTKLEIK

SEQ ID NO: 16141 - protein, 10 aa, Artificial Sequence
  Description of Artificial Sequence: Synthetic peptide
FGGGTKLEIK

SEQ ID NO: 16142 - protein, 10 aa, Artificial Sequence
  Description of Artificial Sequence: Synthetic peptide
FGPGTKLEIK

SEQ ID NO: 16143 - protein, 10 aa, Artificial Sequence
  Description of Artificial Sequence: Synthetic peptide
FGPGTKLEIK

SEQ ID NO: 16144 - protein, 10 aa, Artificial Sequence
  Description of Artificial Sequence: Synthetic peptide
FGPGTKLEIK

SEQ ID NO: 16145 - protein, 10 aa, Artificial Sequence
  Description of Artificial Sequence: Synthetic peptide
FGPGTKLEIK

SEQ ID NO: 16146 - protein, 10 aa, Artificial Sequence
  Description of Artificial Sequence: Synthetic peptide
FGPGTKLEIK

SEQ ID NO: 16147 - protein, 10 aa, Artificial Sequence
  Description of Artificial Sequence: Synthetic peptide
FGGGTKVEIK

SEQ ID NO: 16148 - protein, 10 aa, Artificial Sequence
  Description of Artificial Sequence: Synthetic peptide
FGGGTKVEIK

SEQ ID NO: 16149 - protein, 10 aa, Artificial Sequence
  Description of Artificial Sequence: Synthetic peptide
FGGGTKVEIK

SEQ ID NO: 16150 - protein, 10 aa, Artificial Sequence
  Description of Artificial Sequence: Synthetic peptide
FGGGTKVEIK

SEQ ID NO: 16151 - protein, 10 aa, Artificial Sequence
  Description of Artificial Sequence: Synthetic peptide
FGGGTKVEIK

SEQ ID NO: 16152 - protein, 10 aa, Artificial Sequence
  Description of Artificial Sequence: Synthetic peptide
FGPGTKVDIK

SEQ ID NO: 16153 - protein, 10 aa, Artificial Sequence
  Description of Artificial Sequence: Synthetic peptide
FGPGTKVEIK

SEQ ID NO: 16154 - protein, 10 aa, Artificial Sequence
  Description of Artificial Sequence: Synthetic peptide
FGPGTKVDIK

SEQ ID NO: 16155 - protein, 10 aa, Artificial Sequence
  Description of Artificial Sequence: Synthetic peptide
FGPGTKVDIK

SEQ ID NO: 16156 - protein, 10 aa, Artificial Sequence
  Description of Artificial Sequence: Synthetic peptide
FGPGTKVDIK

SEQ ID NO: 16157 - protein, 10 aa, Artificial Sequence
  Description of Artificial Sequence: Synthetic peptide
FGPGTKVDIK

SEQ ID NO: 16158 - protein, 10 aa, Artificial Sequence
  Description of Artificial Sequence: Synthetic peptide
FGPGTKVEIK

SEQ ID NO: 16159 - protein, 10 aa, Artificial Sequence
  Description of Artificial Sequence: Synthetic peptide
FGPGTKVEIK

SEQ ID NO: 16160 - protein, 10 aa, Artificial Sequence
  Description of Artificial Sequence: Synthetic peptide
FGPGTKVEIK

SEQ ID NO: 16161 - protein, 10 aa, Artificial Sequence
  Description of Artificial Sequence: Synthetic peptide
FGPGTKVEIK

SEQ ID NO: 16162 - protein, 10 aa, Artificial Sequence
  Description of Artificial Sequence: Synthetic peptide
FGPGTKVDIK

SEQ ID NO: 16163 - protein, 10 aa, Artificial Sequence
  Description of Artificial Sequence: Synthetic peptide
FGPGTKVEIK

SEQ ID NO: 16164 - protein, 10 aa, Artificial Sequence
  Description of Artificial Sequence: Synthetic peptide
FGPGTKVEIK

SEQ ID NO: 16165 - protein, 10 aa, Artificial Sequence
  Description of Artificial Sequence: Synthetic peptide
FGPGTKVDIK

SEQ ID NO: 16166 - protein, 10 aa, Artificial Sequence
  Description of Artificial Sequence: Synthetic peptide
FGPGTKVDIK

SEQ ID NO: 16167 - protein, 10 aa, Artificial Sequence
  Description of Artificial Sequence: Synthetic peptide
FGPGTKVDIK

SEQ ID NO: 16168 - protein, 10 aa, Artificial Sequence
  Description of Artificial Sequence: Synthetic peptide
FGPGTKVEIK

SEQ ID NO: 16169 - protein, 10 aa, Artificial Sequence
  Description of Artificial Sequence: Synthetic peptide
FGPGTKVEIK

SEQ ID NO: 16170 - protein, 10 aa, Artificial Sequence
  Description of Artificial Sequence: Synthetic peptide
FGPGTKVEIK

SEQ ID NO: 16171 - protein, 10 aa, Artificial Sequence
  Description of Artificial Sequence: Synthetic peptide
FGPGTKVDIK

SEQ ID NO: 16172 - protein, 10 aa, Artificial Sequence
  Description of Artificial Sequence: Synthetic peptide
FGPGTKVDIK

SEQ ID NO: 16173 - protein, 10 aa, Artificial Sequence
  Description of Artificial Sequence: Synthetic peptide
FGPGTKVDIK

SEQ ID NO: 16174 - protein, 10 aa, Artificial Sequence
  Description of Artificial Sequence: Synthetic peptide
FGGGTKVEIK

SEQ ID NO: 16175 - protein, 10 aa, Artificial Sequence
  Description of Artificial Sequence: Synthetic peptide
FGGGTKVDIK

SEQ ID NO: 16176 - protein, 10 aa, Artificial Sequence
  Description of Artificial Sequence: Synthetic peptide
FGQGTKVEIK

SEQ ID NO: 16177 - protein, 10 aa, Artificial Sequence
  Description of Artificial Sequence: Synthetic peptide
FGQGTKVEIK

SEQ ID NO: 16178 - protein, 10 aa, Artificial Sequence
  Description of Artificial Sequence: Synthetic peptide
FGQGTKLEIK

SEQ ID NO: 16179 - protein, 10 aa, Artificial Sequence
  Description of Artificial Sequence: Synthetic peptide
FGPGTKLEIK

SEQ ID NO: 16180 - protein, 10 aa, Artificial Sequence
  Description of Artificial Sequence: Synthetic peptide
FGQGTRLEIK

SEQ ID NO: 16181 - protein, 10 aa, Artificial Sequence
  Description of Artificial Sequence: Synthetic peptide
FGQGTRLEIK

SEQ ID NO: 16182 - protein, 10 aa, Artificial Sequence
  Description of Artificial Sequence: Synthetic peptide
FGQGTRLEIK

SEQ ID NO: 16183 - protein, 10 aa, Artificial Sequence
  Description of Artificial Sequence: Synthetic peptide
FGQGTRLEIK

SEQ ID NO: 16184 - protein, 10 aa, Artificial Sequence
  Description of Artificial Sequence: Synthetic peptide
FGQGTRLEIK

SEQ ID NO: 16185 - protein, 10 aa, Artificial Sequence
  Description of Artificial Sequence: Synthetic peptide
FGGGTKLTVL

SEQ ID NO: 16186 - protein, 10 aa, Artificial Sequence
  Description of Artificial Sequence: Synthetic peptide
FGGGTKLTVL

SEQ ID NO: 16187 - protein, 10 aa, Artificial Sequence
  Description of Artificial Sequence: Synthetic peptide
FGGGTKLTVL

SEQ ID NO: 16188 - protein, 10 aa, Artificial Sequence
  Description of Artificial Sequence: Synthetic peptide
FGGGTKLTVL

SEQ ID NO: 16189 - protein, 10 aa, Artificial Sequence
  Description of Artificial Sequence: Synthetic peptide
FGGGTKLTVL

SEQ ID NO: 16190 - protein, 10 aa, Artificial Sequence
  Description of Artificial Sequence: Synthetic peptide
FGGGTKLTVL

SEQ ID NO: 16191 - protein, 10 aa, Artificial Sequence
  Description of Artificial Sequence: Synthetic peptide
FGGGTKLTVL

SEQ ID NO: 16192 - protein, 10 aa, Artificial Sequence
  Description of Artificial Sequence: Synthetic peptide
FGGGTKLTVL

SEQ ID NO: 16193 - protein, 10 aa, Artificial Sequence
  Description of Artificial Sequence: Synthetic peptide
FGGGTKLTVL

SEQ ID NO: 16194 - protein, 10 aa, Artificial Sequence
  Description of Artificial Sequence: Synthetic peptide
FGGGTKLTVL

SEQ ID NO: 16195 - protein, 10 aa, Artificial Sequence
  Description of Artificial Sequence: Synthetic peptide
FGGGTKLTVL

SEQ ID NO: 16196 - protein, 10 aa, Artificial Sequence
  Description of Artificial Sequence: Synthetic peptide
FGGGTKLTVL

SEQ ID NO: 16197 - protein, 10 aa, Artificial Sequence
  Description of Artificial Sequence: Synthetic peptide
FGGGTKLTVL

SEQ ID NO: 16198 - protein, 10 aa, Artificial Sequence
  Description of Artificial Sequence: Synthetic peptide
FGGGTKLTVL

SEQ ID NO: 16199 - protein, 10 aa, Artificial Sequence
  Description of Artificial Sequence: Synthetic peptide
FGGGTKLTVL

SEQ ID NO: 16200 - protein, 10 aa, Artificial Sequence
  Description of Artificial Sequence: Synthetic peptide
FGGGTKLTVL

SEQ ID NO: 16201 - protein, 10 aa, Artificial Sequence
  Description of Artificial Sequence: Synthetic peptide
FGGGTKLTVL

SEQ ID NO: 16202 - protein, 10 aa, Artificial Sequence
  Description of Artificial Sequence: Synthetic peptide
FGGGTKLTVL

SEQ ID NO: 16203 - protein, 10 aa, Artificial Sequence
  Description of Artificial Sequence: Synthetic peptide
FGGGTKLTVL

SEQ ID NO: 16204 - protein, 10 aa, Artificial Sequence
  Description of Artificial Sequence: Synthetic peptide
FGGGTKLTVL

SEQ ID NO: 16205 - protein, 10 aa, Artificial Sequence
  Description of Artificial Sequence: Synthetic peptide
FGGGTKLTVL

SEQ ID NO: 16206 - protein, 10 aa, Artificial Sequence
  Description of Artificial Sequence: Synthetic peptide
FGGGTKLTVL

SEQ ID NO: 16207 - protein, 10 aa, Artificial Sequence
  Description of Artificial Sequence: Synthetic peptide
FGGGTKLTVL

SEQ ID NO: 16208 - protein, 10 aa, Artificial Sequence
  Description of Artificial Sequence: Synthetic peptide
FGGGTKLTVL

SEQ ID NO: 16209 - protein, 10 aa, Artificial Sequence
  Description of Artificial Sequence: Synthetic peptide
FGGGTKLTVL

SEQ ID NO: 16210 - protein, 10 aa, Artificial Sequence
  Description of Artificial Sequence: Synthetic peptide
FGGGTKLTVL

SEQ ID NO: 16211 - protein, 10 aa, Artificial Sequence
  Description of Artificial Sequence: Synthetic peptide
FGGGTKLTVL

SEQ ID NO: 16212 - protein, 10 aa, Artificial Sequence
  Description of Artificial Sequence: Synthetic peptide
FGGGTKLTVL

SEQ ID NO: 16213 - protein, 10 aa, Artificial Sequence
  Description of Artificial Sequence: Synthetic peptide
FGGGTKLTVL

SEQ ID NO: 16214 - protein, 10 aa, Artificial Sequence
  Description of Artificial Sequence: Synthetic peptide
FGGGTKLTVL

SEQ ID NO: 16215 - protein, 10 aa, Artificial Sequence
  Description of Artificial Sequence: Synthetic peptide
FGGGTKLTVL

SEQ ID NO: 16216 - protein, 10 aa, Artificial Sequence
  Description of Artificial Sequence: Synthetic peptide
FGGGTKLTVL

SEQ ID NO: 16217 - protein, 10 aa, Artificial Sequence
  Description of Artificial Sequence: Synthetic peptide
FGGGTKLTVL

SEQ ID NO: 16218 - protein, 10 aa, Artificial Sequence
  Description of Artificial Sequence: Synthetic peptide
FGGGTKLTVL

SEQ ID NO: 16219 - protein, 10 aa, Artificial Sequence
  Description of Artificial Sequence: Synthetic peptide
FGGGTKLTVL

SEQ ID NO: 16220 - protein, 10 aa, Artificial Sequence
  Description of Artificial Sequence: Synthetic peptide
FGGGTKLTVL

SEQ ID NO: 16221 - protein, 10 aa, Artificial Sequence
  Description of Artificial Sequence: Synthetic peptide
FGGGTKLTVL

SEQ ID NO: 16222 - protein, 10 aa, Artificial Sequence
  Description of Artificial Sequence: Synthetic peptide
FGGGTKLTVL

SEQ ID NO: 16223 - protein, 10 aa, Artificial Sequence
  Description of Artificial Sequence: Synthetic peptide
FGGGTKLTVL

SEQ ID NO: 16224 - protein, 10 aa, Artificial Sequence
  Description of Artificial Sequence: Synthetic peptide
FGGGTKLTVL

SEQ ID NO: 16225 - protein, 10 aa, Artificial Sequence
  Description of Artificial Sequence: Synthetic peptide
FGGGTKLTVL

SEQ ID NO: 16226 - protein, 10 aa, Artificial Sequence
  Description of Artificial Sequence: Synthetic peptide
FGGGTKLTVL

SEQ ID NO: 16227 - protein, 10 aa, Artificial Sequence
  Description of Artificial Sequence: Synthetic peptide
FGGGTKLTVL

SEQ ID NO: 16228 - protein, 10 aa, Artificial Sequence
  Description of Artificial Sequence: Synthetic peptide
FGGGTKLTVL

SEQ ID NO: 16229 - protein, 10 aa, Artificial Sequence
  Description of Artificial Sequence: Synthetic peptide
FGGGTKLTVL

SEQ ID NO: 16230 - protein, 10 aa, Artificial Sequence
  Description of Artificial Sequence: Synthetic peptide
FGGGTKLTVL

SEQ ID NO: 16231 - protein, 10 aa, Artificial Sequence
  Description of Artificial Sequence: Synthetic peptide
FGGGTKLTVL

SEQ ID NO: 16232 - protein, 10 aa, Artificial Sequence
  Description of Artificial Sequence: Synthetic peptide
FGGGTKLTVL

SEQ ID NO: 16233 - protein, 10 aa, Artificial Sequence
  Description of Artificial Sequence: Synthetic peptide
FGGGTKLTVL

SEQ ID NO: 16234 - protein, 10 aa, Artificial Sequence
  Description of Artificial Sequence: Synthetic peptide
FGGGTKLTVL

SEQ ID NO: 16235 - protein, 10 aa, Artificial Sequence
  Description of Artificial Sequence: Synthetic peptide
FGGGTKLTVL

SEQ ID NO: 16236 - protein, 10 aa, Artificial Sequence
  Description of Artificial Sequence: Synthetic peptide
FGGGTKLTVL

SEQ ID NO: 16237 - protein, 10 aa, Artificial Sequence
  Description of Artificial Sequence: Synthetic peptide
FGGGTKLTVL

SEQ ID NO: 16238 - protein, 10 aa, Artificial Sequence
  Description of Artificial Sequence: Synthetic peptide
FGGGTKLTVL

SEQ ID NO: 16239 - protein, 10 aa, Artificial Sequence
  Description of Artificial Sequence: Synthetic peptide
FGGGTKLTVL

SEQ ID NO: 16240 - protein, 10 aa, Artificial Sequence
  Description of Artificial Sequence: Synthetic peptide
FGGGTKLTVL

SEQ ID NO: 16241 - protein, 10 aa, Artificial Sequence
  Description of Artificial Sequence: Synthetic peptide
FGGGTKLTVL

SEQ ID NO: 16242 - protein, 10 aa, Artificial Sequence
  Description of Artificial Sequence: Synthetic peptide
FGGGTKLTVL

SEQ ID NO: 16243 - protein, 10 aa, Artificial Sequence
  Description of Artificial Sequence: Synthetic peptide
FGGGTKLTVL

SEQ ID NO: 16244 - protein, 10 aa, Artificial Sequence
  Description of Artificial Sequence: Synthetic peptide
FGGGTKLTVL

SEQ ID NO: 16245 - protein, 10 aa, Artificial Sequence
  Description of Artificial Sequence: Synthetic peptide
FGGGTKLTVL

SEQ ID NO: 16246 - protein, 10 aa, Artificial Sequence
  Description of Artificial Sequence: Synthetic peptide
FGGGTKLTVL

SEQ ID NO: 16247 - protein, 10 aa, Artificial Sequence
  Description of Artificial Sequence: Synthetic peptide
FGGGTKLTVL

SEQ ID NO: 16248 - protein, 10 aa, Artificial Sequence
  Description of Artificial Sequence: Synthetic peptide
FGGGTKLTVL

SEQ ID NO: 16249 - protein, 10 aa, Artificial Sequence
  Description of Artificial Sequence: Synthetic peptide
FGGGTKLTVL

SEQ ID NO: 16250 - protein, 10 aa, Artificial Sequence
  Description of Artificial Sequence: Synthetic peptide
FGGGTKLTVL

SEQ ID NO: 16251 - protein, 10 aa, Artificial Sequence
  Description of Artificial Sequence: Synthetic peptide
FGGGTKLTVL

SEQ ID NO: 16252 - protein, 10 aa, Artificial Sequence
  Description of Artificial Sequence: Synthetic peptide
FGGGTKLTVL

SEQ ID NO: 16253 - protein, 10 aa, Artificial Sequence
  Description of Artificial Sequence: Synthetic peptide
FGGGTKLTVL

SEQ ID NO: 16254 - protein, 10 aa, Artificial Sequence
  Description of Artificial Sequence: Synthetic peptide
FGGGTKLTVL

SEQ ID NO: 16255 - protein, 10 aa, Artificial Sequence
  Description of Artificial Sequence: Synthetic peptide
FGGGTKLTVL

SEQ ID NO: 16256 - protein, 10 aa, Artificial Sequence
  Description of Artificial Sequence: Synthetic peptide
FGGGTKLTVL

SEQ ID NO: 16257 - protein, 10 aa, Artificial Sequence
  Description of Artificial Sequence: Synthetic peptide
FGGGTKLTVL

SEQ ID NO: 16258 - protein, 11 aa, Artificial Sequence
  Description of Artificial Sequence: Synthetic peptide
WGQGTLVTVSS

SEQ ID NO: 16259 - protein, 11 aa, Artificial Sequence
  Description of Artificial Sequence: Synthetic peptide
WGQGTLVTVSS

SEQ ID NO: 16260 - protein, 11 aa, Artificial Sequence
  Description of Artificial Sequence: Synthetic peptide
WGQGTLVTVSS

SEQ ID NO: 16261 - protein, 11 aa, Artificial Sequence
  Description of Artificial Sequence: Synthetic peptide
WGQGTRVTVSS

SEQ ID NO: 16262 - protein, 11 aa, Artificial Sequence
  Description of Artificial Sequence: Synthetic peptide
WGQGTMVTVSS

SEQ ID NO: 16263 - protein, 11 aa, Artificial Sequence
  Description of Artificial Sequence: Synthetic peptide
WGQGTSVTVSS

SEQ ID NO: 16264 - protein, 11 aa, Artificial Sequence
  Description of Artificial Sequence: Synthetic peptide
WGQGTTVTVSS

SEQ ID NO: 16265 - protein, 11 aa, Artificial Sequence
  Description of Artificial Sequence: Synthetic peptide
WGQGTTVTVSS

SEQ ID NO: 16266 - protein, 11 aa, Artificial Sequence
  Description of Artificial Sequence: Synthetic peptide
WGQGTTVTVSS

SEQ ID NO: 16267 - protein, 11 aa, Artificial Sequence
  Description of Artificial Sequence: Synthetic peptide
WGQGTTVTVSS

SEQ ID NO: 16268 - protein, 11 aa, Artificial Sequence
  Description of Artificial Sequence: Synthetic peptide
WGQGTTVTVSS

SEQ ID NO: 16269 - protein, 11 aa, Artificial Sequence
  Description of Artificial Sequence: Synthetic peptide
WGQGTTVTVSS

SEQ ID NO: 16270 - protein, 11 aa, Artificial Sequence
  Description of Artificial Sequence: Synthetic peptide
WGQGTTVTVSS

SEQ ID NO: 16271 - protein, 11 aa, Artificial Sequence
  Description of Artificial Sequence: Synthetic peptide
WGQGTTVTVSS

SEQ ID NO: 16272 - protein, 11 aa, Artificial Sequence
  Description of Artificial Sequence: Synthetic peptide
WGQGTTVTVSS

SEQ ID NO: 16273 - protein, 11 aa, Artificial Sequence
  Description of Artificial Sequence: Synthetic peptide
WGQGTTVTVSS

SEQ ID NO: 16274 - protein, 11 aa, Artificial Sequence
  Description of Artificial Sequence: Synthetic peptide
WGQGTTVTVSS

SEQ ID NO: 16275 - protein, 11 aa, Artificial Sequence
  Description of Artificial Sequence: Synthetic peptide
WGQGTTVTVSS

SEQ ID NO: 16276 - protein, 11 aa, Artificial Sequence
  Description of Artificial Sequence: Synthetic peptide
WGQGTTVTVSS

SEQ ID NO: 16277 - protein, 11 aa, Artificial Sequence
  Description of Artificial Sequence: Synthetic peptide
WGQGTTVTVSS

SEQ ID NO: 16278 - protein, 11 aa, Artificial Sequence
  Description of Artificial Sequence: Synthetic peptide
WGQGTTVTVSS

SEQ ID NO: 16279 - protein, 11 aa, Artificial Sequence
  Description of Artificial Sequence: Synthetic peptide
WGQGTTVTVSS

SEQ ID NO: 16280 - protein, 11 aa, Artificial Sequence
  Description of Artificial Sequence: Synthetic peptide
WGQGTTVTVSS

SEQ ID NO: 16281 - protein, 11 aa, Artificial Sequence
  Description of Artificial Sequence: Synthetic peptide
WGQGTTVTVSS

SEQ ID NO: 16282 - protein, 11 aa, Artificial Sequence
  Description of Artificial Sequence: Synthetic peptide
WGQGTLVTVSS

SEQ ID NO: 16283 - protein, 11 aa, Artificial Sequence
  Description of Artificial Sequence: Synthetic peptide
WGQGTLVTVSS

SEQ ID NO: 16284 - protein, 11 aa, Artificial Sequence
  Description of Artificial Sequence: Synthetic peptide
WGQGTLVTVSS

SEQ ID NO: 16285 - protein, 11 aa, Artificial Sequence
  Description of Artificial Sequence: Synthetic peptide
WGQGTLVTVSS

SEQ ID NO: 16286 - protein, 11 aa, Artificial Sequence
  Description of Artificial Sequence: Synthetic peptide
WGQGTLVTVSS

SEQ ID NO: 16287 - protein, 11 aa, Artificial Sequence
  Description of Artificial Sequence: Synthetic peptide
WGQGTLVTVSS

SEQ ID NO: 16288 - protein, 11 aa, Artificial Sequence
  Description of Artificial Sequence: Synthetic peptide
WGQGTTVTVSS

SEQ ID NO: 16289 - protein, 11 aa, Artificial Sequence
  Description of Artificial Sequence: Synthetic peptide
WGQGTTVTVSS

SEQ ID NO: 16290 - protein, 11 aa, Artificial Sequence
  Description of Artificial Sequence: Synthetic peptide
WGQGTTVTVSS

SEQ ID NO: 16291 - protein, 11 aa, Artificial Sequence
  Description of Artificial Sequence: Synthetic peptide
WGQGTTVTVSS

SEQ ID NO: 16292 - protein, 11 aa, Artificial Sequence
  Description of Artificial Sequence: Synthetic peptide
WGQGTTVTVSS

SEQ ID NO: 16293 - protein, 11 aa, Artificial Sequence
  Description of Artificial Sequence: Synthetic peptide
WGQGTTVTVSS

SEQ ID NO: 16294 - protein, 11 aa, Artificial Sequence
  Description of Artificial Sequence: Synthetic peptide
WGQGTTVTVSS

SEQ ID NO: 16295 - protein, 11 aa, Artificial Sequence
  Description of Artificial Sequence: Synthetic peptide
WGQGTTVTVSS

SEQ ID NO: 16296 - protein, 11 aa, Artificial Sequence
  Description of Artificial Sequence: Synthetic peptide
WGQGTTVTVSS

SEQ ID NO: 16297 - protein, 11 aa, Artificial Sequence
  Description of Artificial Sequence: Synthetic peptide
WGQGTTVTVSS

SEQ ID NO: 16298 - protein, 11 aa, Artificial Sequence
  Description of Artificial Sequence: Synthetic peptide
WGQGTTVTVSS

SEQ ID NO: 16299 - protein, 11 aa, Artificial Sequence
  Description of Artificial Sequence: Synthetic peptide
WGQGTTVTVSS

SEQ ID NO: 16300 - protein, 11 aa, Artificial Sequence
  Description of Artificial Sequence: Synthetic peptide
WGQGTTVTVSS

SEQ ID NO: 16301 - protein, 11 aa, Artificial Sequence
  Description of Artificial Sequence: Synthetic peptide
WGQGTTVTVSS

SEQ ID NO: 16302 - protein, 11 aa, Artificial Sequence
  Description of Artificial Sequence: Synthetic peptide
WGQGTTVTVSS

SEQ ID NO: 16303 - protein, 11 aa, Artificial Sequence
  Description of Artificial Sequence: Synthetic peptide
WGQGTTVTVSS

SEQ ID NO: 16304 - protein, 11 aa, Artificial Sequence
  Description of Artificial Sequence: Synthetic peptide
WGQGTTVTVSS

SEQ ID NO: 16305 - protein, 11 aa, Artificial Sequence
  Description of Artificial Sequence: Synthetic peptide
WGQGTTVTVSS

SEQ ID NO: 16306 - protein, 11 aa, Artificial Sequence
  Description of Artificial Sequence: Synthetic peptide
WGQGTTVTVSS

SEQ ID NO: 16307 - protein, 11 aa, Artificial Sequence
  Description of Artificial Sequence: Synthetic peptide
WGQGTTVTVSS

SEQ ID NO: 16308 - protein, 11 aa, Artificial Sequence
  Description of Artificial Sequence: Synthetic peptide
WGQGTTVTVSS

SEQ ID NO: 16309 - protein, 11 aa, Artificial Sequence
  Description of Artificial Sequence: Synthetic peptide
WGQGTTVTVSS

SEQ ID NO: 16310 - protein, 11 aa, Artificial Sequence
  Description of Artificial Sequence: Synthetic peptide
WGQGTTVTVSS

SEQ ID NO: 16311 - protein, 11 aa, Artificial Sequence
  Description of Artificial Sequence: Synthetic peptide
WGQGTTVTVSS

SEQ ID NO: 16312 - protein, 11 aa, Artificial Sequence
  Description of Artificial Sequence: Synthetic peptide
WGQGTTVTVSS

SEQ ID NO: 16313 - protein, 11 aa, Artificial Sequence
  Description of Artificial Sequence: Synthetic peptide
WGQGTTVTVSS

SEQ ID NO: 16314 - protein, 11 aa, Artificial Sequence
  Description of Artificial Sequence: Synthetic peptide
WGQGTTVTVSS

SEQ ID NO: 16315 - protein, 11 aa, Artificial Sequence
  Description of Artificial Sequence: Synthetic peptide
WGQGTTVTVSS

SEQ ID NO: 16316 - protein, 11 aa, Artificial Sequence
  Description of Artificial Sequence: Synthetic peptide
WGQGTTVTVSS

SEQ ID NO: 16317 - protein, 11 aa, Artificial Sequence
  Description of Artificial Sequence: Synthetic peptide
WGLGTTVTVSS

SEQ ID NO: 16318 - protein, 11 aa, Artificial Sequence
  Description of Artificial Sequence: Synthetic peptide
WGQGTTVTVSS

SEQ ID NO: 16319 - protein, 11 aa, Artificial Sequence
  Description of Artificial Sequence: Synthetic peptide
WGQGTTVTVSS

SEQ ID NO: 16320 - protein, 11 aa, Artificial Sequence
  Description of Artificial Sequence: Synthetic peptide
WGPGTTVTVSS

SEQ ID NO: 16321 - protein, 11 aa, Artificial Sequence
  Description of Artificial Sequence: Synthetic peptide
WGQGTTVTVSS

SEQ ID NO: 16322 - protein, 11 aa, Artificial Sequence
  Description of Artificial Sequence: Synthetic peptide
WGLGTTVTVSS

SEQ ID NO: 16323 - protein, 11 aa, Artificial Sequence
  Description of Artificial Sequence: Synthetic peptide
WGLGTTVTVSS

SEQ ID NO: 16324 - protein, 11 aa, Artificial Sequence
  Description of Artificial Sequence: Synthetic peptide
WGQGTTVTVSS

SEQ ID NO: 16325 - protein, 11 aa, Artificial Sequence
  Description of Artificial Sequence: Synthetic peptide
WGQGTTVTVSS

SEQ ID NO: 16326 - protein, 11 aa, Artificial Sequence
  Description of Artificial Sequence: Synthetic peptide
WGQGTTVTVSS

SEQ ID NO: 16327 - protein, 11 aa, Artificial Sequence
  Description of Artificial Sequence: Synthetic peptide
WGQGTTVTVSS

SEQ ID NO: 16328 - protein, 11 aa, Artificial Sequence
  Description of Artificial Sequence: Synthetic peptide
WGPGTTVTVSS

SEQ ID NO: 16329 - protein, 11 aa, Artificial Sequence
  Description of Artificial Sequence: Synthetic peptide
WGPGTTVTVSS

SEQ ID NO: 16330 - protein, 11 aa, Artificial Sequence
  Description of Artificial Sequence: Synthetic peptide
WGLGTTVTVSS

SEQ ID NO: 16331 - protein, 11 aa, Artificial Sequence
  Description of Artificial Sequence: Synthetic peptide
WGLGTTVTVSS

SEQ ID NO: 16332 - protein, 11 aa, Artificial Sequence
  Description of Artificial Sequence: Synthetic peptide
WGLGTTVTVSS

SEQ ID NO: 16333 - protein, 11 aa, Artificial Sequence
  Description of Artificial Sequence: Synthetic peptide
WGQGTTVTVSS

SEQ ID NO: 16334 - protein, 11 aa, Artificial Sequence
  Description of Artificial Sequence: Synthetic peptide
WGQGTTVTVSS

SEQ ID NO: 16335 - protein, 11 aa, Artificial Sequence
  Description of Artificial Sequence: Synthetic peptide
WGQGTTVTVSS

SEQ ID NO: 16336 - protein, 11 aa, Artificial Sequence
  Description of Artificial Sequence: Synthetic peptide
WGQGTTVTVSS

SEQ ID NO: 16337 - protein, 11 aa, Artificial Sequence
  Description of Artificial Sequence: Synthetic peptide
WGQGTTVTVSS

SEQ ID NO: 16338 - protein, 11 aa, Artificial Sequence
  Description of Artificial Sequence: Synthetic peptide
WGQGTTVTVSS

SEQ ID NO: 16339 - protein, 11 aa, Artificial Sequence
  Description of Artificial Sequence: Synthetic peptide
WGQGTTVTVSS

SEQ ID NO: 16340 - protein, 11 aa, Artificial Sequence
  Description of Artificial Sequence: Synthetic peptide
WGQGTTVTVSS

SEQ ID NO: 16341 - protein, 11 aa, Artificial Sequence
  Description of Artificial Sequence: Synthetic peptide
WGQGTTVTVSS

SEQ ID NO: 16342 - protein, 11 aa, Artificial Sequence
  Description of Artificial Sequence: Synthetic peptide
WGQGTTVTVSS

SEQ ID NO: 16343 - protein, 11 aa, Artificial Sequence
  Description of Artificial Sequence: Synthetic peptide
WGQGTTVTVSS

SEQ ID NO: 16344 - protein, 11 aa, Artificial Sequence
  Description of Artificial Sequence: Synthetic peptide
WGQGTTVTVSS

SEQ ID NO: 16345 - protein, 11 aa, Artificial Sequence
  Description of Artificial Sequence: Synthetic peptide
WGQGTTVTVSS

SEQ ID NO: 16346 - protein, 11 aa, Artificial Sequence
  Description of Artificial Sequence: Synthetic peptide
WGQGTTVTVSS

SEQ ID NO: 16347 - protein, 11 aa, Artificial Sequence
  Description of Artificial Sequence: Synthetic peptide
WGQGTTVTVSS

SEQ ID NO: 16348 - protein, 11 aa, Artificial Sequence
  Description of Artificial Sequence: Synthetic peptide
WGQGTTVTVSS

SEQ ID NO: 16349 - protein, 11 aa, Artificial Sequence
  Description of Artificial Sequence: Synthetic peptide
WGQGTLVTVSS

SEQ ID NO: 16350 - protein, 11 aa, Artificial Sequence
  Description of Artificial Sequence: Synthetic peptide
WGQGTLVTVSS

SEQ ID NO: 16351 - protein, 11 aa, Artificial Sequence
  Description of Artificial Sequence: Synthetic peptide
WGQGTLVTVSS

SEQ ID NO: 16352 - protein, 11 aa, Artificial Sequence
  Description of Artificial Sequence: Synthetic peptide
WGQGTLVTVSS

SEQ ID NO: 16353 - protein, 11 aa, Artificial Sequence
  Description of Artificial Sequence: Synthetic peptide
WGQGTLVTVSS

SEQ ID NO: 16354 - protein, 11 aa, Artificial Sequence
  Description of Artificial Sequence: Synthetic peptide
WGQGTTVTVSS

SEQ ID NO: 16355 - protein, 11 aa, Artificial Sequence
  Description of Artificial Sequence: Synthetic peptide
WGQGTTVTVSS

SEQ ID NO: 16356 - protein, 11 aa, Artificial Sequence
  Description of Artificial Sequence: Synthetic peptide
WGQGTLVTVSS

SEQ ID NO: 16357 - protein, 11 aa, Artificial Sequence
  Description of Artificial Sequence: Synthetic peptide
WGQGNLVTVSS

SEQ ID NO: 16358 - protein, 11 aa, Artificial Sequence
  Description of Artificial Sequence: Synthetic peptide
WGQGTLVTVSS

SEQ ID NO: 16359 - protein, 11 aa, Artificial Sequence
  Description of Artificial Sequence: Synthetic peptide
WGQGTLVTVSS

SEQ ID NO: 16360 - protein, 11 aa, Artificial Sequence
  Description of Artificial Sequence: Synthetic peptide
WGQGILVTVSS

SEQ ID NO: 16361 - protein, 11 aa, Artificial Sequence
  Description of Artificial Sequence: Synthetic peptide
WGQGTLVTVSS

SEQ ID NO: 16362 - protein, 11 aa, Artificial Sequence
  Description of Artificial Sequence: Synthetic peptide
WGQGTTVTVSS

SEQ ID NO: 16363 - protein, 11 aa, Artificial Sequence
  Description of Artificial Sequence: Synthetic peptide
WGQGTTVTVSS

SEQ ID NO: 16364 - protein, 11 aa, Artificial Sequence
  Description of Artificial Sequence: Synthetic peptide
WGQGTLVTVSS

SEQ ID NO: 16365 - protein, 11 aa, Artificial Sequence
  Description of Artificial Sequence: Synthetic peptide
WGQGNLVTVSS

SEQ ID NO: 16366 - protein, 11 aa, Artificial Sequence
  Description of Artificial Sequence: Synthetic peptide
WGQGTLVTVSS

SEQ ID NO: 16367 - protein, 11 aa, Artificial Sequence
  Description of Artificial Sequence: Synthetic peptide
WGQGTLVTVSS

SEQ ID NO: 16368 - protein, 11 aa, Artificial Sequence
  Description of Artificial Sequence: Synthetic peptide
WGQGTLVTVSS

SEQ ID NO: 16369 - protein, 11 aa, Artificial Sequence
  Description of Artificial Sequence: Synthetic peptide
WGQGTLVTVSS

SEQ ID NO: 16370 - protein, 11 aa, Artificial Sequence
  Description of Artificial Sequence: Synthetic peptide
WGQGTLVTVSS

SEQ ID NO: 16371 - protein, 11 aa, Artificial Sequence
  Description of Artificial Sequence: Synthetic peptide
WGQGTLVTVSS

SEQ ID NO: 16372 - protein, 11 aa, Artificial Sequence
  Description of Artificial Sequence: Synthetic peptide
WGQGTLVTVSS

SEQ ID NO: 16373 - protein, 11 aa, Artificial Sequence
  Description of Artificial Sequence: Synthetic peptide
WGQGTLVTVSS

SEQ ID NO: 16374 - protein, 11 aa, Artificial Sequence
  Description of Artificial Sequence: Synthetic peptide
WGQGTLVTVSS

SEQ ID NO: 16375 - protein, 11 aa, Artificial Sequence
  Description of Artificial Sequence: Synthetic peptide
WGQGTLVTVSS

SEQ ID NO: 16376 - protein, 11 aa, Artificial Sequence
  Description of Artificial Sequence: Synthetic peptide
WGQGTLVTVSS

SEQ ID NO: 16377 - protein, 11 aa, Artificial Sequence
  Description of Artificial Sequence: Synthetic peptide
WGQGTTVTVSS

SEQ ID NO: 16378 - protein, 11 aa, Artificial Sequence
  Description of Artificial Sequence: Synthetic peptide
WGQGTTVTVSS

SEQ ID NO: 16379 - protein, 11 aa, Artificial Sequence
  Description of Artificial Sequence: Synthetic peptide
WGQGTTVTVSS

SEQ ID NO: 16380 - protein, 11 aa, Artificial Sequence
  Description of Artificial Sequence: Synthetic peptide
WGQGTTVTVSS

SEQ ID NO: 16381 - protein, 11 aa, Artificial Sequence
  Description of Artificial Sequence: Synthetic peptide
WGQGTTVTVSS

SEQ ID NO: 16382 - protein, 11 aa, Artificial Sequence
  Description of Artificial Sequence: Synthetic peptide
WGLGTTVTVSS

SEQ ID NO: 16383 - protein, 11 aa, Artificial Sequence
  Description of Artificial Sequence: Synthetic peptide
WGQGTTVTVSS

SEQ ID NO: 16384 - protein, 11 aa, Artificial Sequence
  Description of Artificial Sequence: Synthetic peptide
WGQGTTVTVSS

SEQ ID NO: 16385 - protein, 11 aa, Artificial Sequence
  Description of Artificial Sequence: Synthetic peptide
WGQGTTVTVSS

SEQ ID NO: 16386 - protein, 11 aa, Artificial Sequence
  Description of Artificial Sequence: Synthetic peptide
WGQGTTVTVSS

SEQ ID NO: 16387 - protein, 11 aa, Artificial Sequence
  Description of Artificial Sequence: Synthetic peptide
WGQGTTVTVSS

SEQ ID NO: 16388 - protein, 11 aa, Artificial Sequence
  Description of Artificial Sequence: Synthetic peptide
WGQGTTVTVSS

SEQ ID NO: 16389 - protein, 11 aa, Artificial Sequence
  Description of Artificial Sequence: Synthetic peptide
WGQGTTVTVSS

SEQ ID NO: 16390 - protein, 11 aa, Artificial Sequence
  Description of Artificial Sequence: Synthetic peptide
WGQGTTVTVSS

SEQ ID NO: 16391 - protein, 11 aa, Artificial Sequence
  Description of Artificial Sequence: Synthetic peptide
WGQGTTVTVSS

SEQ ID NO: 16392 - protein, 11 aa, Artificial Sequence
  Description of Artificial Sequence: Synthetic peptide
WGQGTTVTVSS

SEQ ID NO: 16393 - protein, 11 aa, Artificial Sequence
  Description of Artificial Sequence: Synthetic peptide
WGQGTTVTVSS

SEQ ID NO: 16394 - protein, 11 aa, Artificial Sequence
  Description of Artificial Sequence: Synthetic peptide
WGQGTTVTVSS

SEQ ID NO: 16395 - protein, 11 aa, Artificial Sequence
  Description of Artificial Sequence: Synthetic peptide
WGQGTTVTVSS

SEQ ID NO: 16396 - protein, 11 aa, Artificial Sequence
  Description of Artificial Sequence: Synthetic peptide
WGQGTTVTVSS

SEQ ID NO: 16397 - protein, 11 aa, Artificial Sequence
  Description of Artificial Sequence: Synthetic peptide
WGQGTTVTVSS

SEQ ID NO: 16398 - protein, 11 aa, Artificial Sequence
  Description of Artificial Sequence: Synthetic peptide
WGQGTTVTVSS

SEQ ID NO: 16399 - protein, 11 aa, Artificial Sequence
  Description of Artificial Sequence: Synthetic peptide
WGQGTTVTVSS

SEQ ID NO: 16400 - protein, 11 aa, Artificial Sequence
  Description of Artificial Sequence: Synthetic peptide
WGQGTTVTVSS

SEQ ID NO: 16401 - protein, 11 aa, Artificial Sequence
  Description of Artificial Sequence: Synthetic peptide
WGQGTTVTVSS

SEQ ID NO: 16402 - protein, 11 aa, Artificial Sequence
  Description of Artificial Sequence: Synthetic peptide
WGQGTTVTVSS

SEQ ID NO: 16403 - protein, 11 aa, Artificial Sequence
  Description of Artificial Sequence: Synthetic peptide
WGQGTTVTVSS

SEQ ID NO: 16404 - protein, 11 aa, Artificial Sequence
  Description of Artificial Sequence: Synthetic peptide
WGQGTTVTVSS

SEQ ID NO: 16405 - protein, 11 aa, Artificial Sequence
  Description of Artificial Sequence: Synthetic peptide
WGQGTTVTVSS

SEQ ID NO: 16406 - protein, 11 aa, Artificial Sequence
  Description of Artificial Sequence: Synthetic peptide
WGQGTTVTVSS

SEQ ID NO: 16407 - protein, 11 aa, Artificial Sequence
  Description of Artificial Sequence: Synthetic peptide
WGQGTTVTVSS

SEQ ID NO: 16408 - protein, 11 aa, Artificial Sequence
  Description of Artificial Sequence: Synthetic peptide
WGQGTTVTVSS

SEQ ID NO: 16409 - protein, 11 aa, Artificial Sequence
  Description of Artificial Sequence: Synthetic peptide
WGQGTTVTVSS

SEQ ID NO: 16410 - protein, 11 aa, Artificial Sequence
  Description of Artificial Sequence: Synthetic peptide
WGQGTTVTVSS

SEQ ID NO: 16411 - protein, 11 aa, Artificial Sequence
  Description of Artificial Sequence: Synthetic peptide
WGQGTTVTVSS

SEQ ID NO: 16412 - protein, 11 aa, Artificial Sequence
  Description of Artificial Sequence: Synthetic peptide
WGQGTTVTVSS

SEQ ID NO: 16413 - protein, 11 aa, Artificial Sequence
  Description of Artificial Sequence: Synthetic peptide
WGQGTTVTVSS

SEQ ID NO: 16414 - protein, 11 aa, Artificial Sequence
  Description of Artificial Sequence: Synthetic peptide
WGQGTTVTVSS

SEQ ID NO: 16415 - protein, 11 aa, Artificial Sequence
  Description of Artificial Sequence: Synthetic peptide
WGQGTLVTVSS

SEQ ID NO: 16416 - protein, 11 aa, Artificial Sequence
  Description of Artificial Sequence: Synthetic peptide
WGQGTLVTVSS

SEQ ID NO: 16417 - protein, 11 aa, Artificial Sequence
  Description of Artificial Sequence: Synthetic peptide
WGQGTLVTVSS

SEQ ID NO: 16418 - protein, 11 aa, Artificial Sequence
  Description of Artificial Sequence: Synthetic peptide
WGQGTLVTVSS

SEQ ID NO: 16419 - protein, 11 aa, Artificial Sequence
  Description of Artificial Sequence: Synthetic peptide
WGQGTLVTVSS

SEQ ID NO: 16420 - protein, 11 aa, Artificial Sequence
  Description of Artificial Sequence: Synthetic peptide
WGQGTLVTVSS

SEQ ID NO: 16421 - protein, 11 aa, Artificial Sequence
  Description of Artificial Sequence: Synthetic peptide
WGQGTLVTVSS

SEQ ID NO: 16422 - protein, 11 aa, Artificial Sequence
  Description of Artificial Sequence: Synthetic peptide
WGQGTLVTVSS

SEQ ID NO: 16423 - protein, 11 aa, Artificial Sequence
  Description of Artificial Sequence: Synthetic peptide
WGQGTLVTVSS

SEQ ID NO: 16424 - protein, 11 aa, Artificial Sequence
  Description of Artificial Sequence: Synthetic peptide
WGQGTLVTVSS

SEQ ID NO: 16425 - protein, 11 aa, Artificial Sequence
  Description of Artificial Sequence: Synthetic peptide
WGQGTLVTVSS

SEQ ID NO: 16426 - protein, 11 aa, Artificial Sequence
  Description of Artificial Sequence: Synthetic peptide
WGQGTLVTVSS

SEQ ID NO: 16427 - protein, 11 aa, Artificial Sequence
  Description of Artificial Sequence: Synthetic peptide
WGQGTLVTVSS

SEQ ID NO: 16428 - protein, 11 aa, Artificial Sequence
  Description of Artificial Sequence: Synthetic peptide
WGQGTLVTVSS

SEQ ID NO: 16429 - protein, 11 aa, Artificial Sequence
  Description of Artificial Sequence: Synthetic peptide
WGQGTLVTVSS

SEQ ID NO: 16430 - protein, 11 aa, Artificial Sequence
  Description of Artificial Sequence: Synthetic peptide
WGQGTLVTVSS

SEQ ID NO: 16431 - protein, 11 aa, Artificial Sequence
  Description of Artificial Sequence: Synthetic peptide
WGQGTLVTVSS

SEQ ID NO: 16432 - protein, 11 aa, Artificial Sequence
  Description of Artificial Sequence: Synthetic peptide
WGQGTLVTVSS

SEQ ID NO: 16433 - protein, 11 aa, Artificial Sequence
  Description of Artificial Sequence: Synthetic peptide
WGQGTLVTVSS

SEQ ID NO: 16434 - protein, 11 aa, Artificial Sequence
  Description of Artificial Sequence: Synthetic peptide
WGQGTLVTVSS

SEQ ID NO: 16435 - protein, 11 aa, Artificial Sequence
  Description of Artificial Sequence: Synthetic peptide
WGQGTLVTVSS

SEQ ID NO: 16436 - protein, 11 aa, Artificial Sequence
  Description of Artificial Sequence: Synthetic peptide
WGQGTLVTVSS

SEQ ID NO: 16437 - protein, 11 aa, Artificial Sequence
  Description of Artificial Sequence: Synthetic peptide
WGQGTLVTVSS

SEQ ID NO: 16438 - protein, 11 aa, Artificial Sequence
  Description of Artificial Sequence: Synthetic peptide
WGQGTLVTVSS

SEQ ID NO: 16439 - protein, 11 aa, Artificial Sequence
  Description of Artificial Sequence: Synthetic peptide
WGQGTLVTVSS

SEQ ID NO: 16440 - protein, 11 aa, Artificial Sequence
  Description of Artificial Sequence: Synthetic peptide
WGQGTLVTVSS

SEQ ID NO: 16441 - protein, 11 aa, Artificial Sequence
  Description of Artificial Sequence: Synthetic peptide
WGQGTLVTVSS

SEQ ID NO: 16442 - protein, 11 aa, Artificial Sequence
  Description of Artificial Sequence: Synthetic peptide
WGQGTLVTVSS

SEQ ID NO: 16443 - protein, 11 aa, Artificial Sequence
  Description of Artificial Sequence: Synthetic peptide
WGQGTLVTVSS

SEQ ID NO: 16444 - protein, 11 aa, Artificial Sequence
  Description of Artificial Sequence: Synthetic peptide
WGQGTLVTVSS

SEQ ID NO: 16445 - protein, 11 aa, Artificial Sequence
  Description of Artificial Sequence: Synthetic peptide
WGQGTLVTVSS

SEQ ID NO: 16446 - protein, 11 aa, Artificial Sequence
  Description of Artificial Sequence: Synthetic peptide
WGQGTLVTVSS

SEQ ID NO: 16447 - protein, 11 aa, Artificial Sequence
  Description of Artificial Sequence: Synthetic peptide
WGQGTLVTVSS

SEQ ID NO: 16448 - protein, 11 aa, Artificial Sequence
  Description of Artificial Sequence: Synthetic peptide
WGQGTLVTVSS

SEQ ID NO: 16449 - protein, 11 aa, Artificial Sequence
  Description of Artificial Sequence: Synthetic peptide
WGQGTLVTVSS

SEQ ID NO: 16450 - protein, 11 aa, Artificial Sequence
  Description of Artificial Sequence: Synthetic peptide
WGQGTLVTVSS

SEQ ID NO: 16451 - protein, 11 aa, Artificial Sequence
  Description of Artificial Sequence: Synthetic peptide
WGQGTLVTVSS

SEQ ID NO: 16452 - protein, 11 aa, Artificial Sequence
  Description of Artificial Sequence: Synthetic peptide
WGQGTLVTVSS

SEQ ID NO: 16453 - protein, 11 aa, Artificial Sequence
  Description of Artificial Sequence: Synthetic peptide
WGQGTLVTVSS

SEQ ID NO: 16454 - protein, 11 aa, Artificial Sequence
  Description of Artificial Sequence: Synthetic peptide
WGQGTLVTVSS

SEQ ID NO: 16455 - protein, 11 aa, Artificial Sequence
  Description of Artificial Sequence: Synthetic peptide
WGQGTLVTVSS

SEQ ID NO: 16456 - protein, 11 aa, Artificial Sequence
  Description of Artificial Sequence: Synthetic peptide
WGQGTLVTVSS

SEQ ID NO: 16457 - protein, 11 aa, Artificial Sequence
  Description of Artificial Sequence: Synthetic peptide
WGQGTLVTVSS

SEQ ID NO: 16458 - protein, 11 aa, Artificial Sequence
  Description of Artificial Sequence: Synthetic peptide
WGQGTLVTVSS

SEQ ID NO: 16459 - protein, 11 aa, Artificial Sequence
  Description of Artificial Sequence: Synthetic peptide
WGQGTLVTVSS

SEQ ID NO: 16460 - protein, 11 aa, Artificial Sequence
  Description of Artificial Sequence: Synthetic peptide
WGQGTLVTVSS

SEQ ID NO: 16461 - protein, 11 aa, Artificial Sequence
  Description of Artificial Sequence: Synthetic peptide
WGQGTLVTVSS

SEQ ID NO: 16462 - protein, 11 aa, Artificial Sequence
  Description of Artificial Sequence: Synthetic peptide
WGQGTLVTVSS

SEQ ID NO: 16463 - protein, 11 aa, Artificial Sequence
  Description of Artificial Sequence: Synthetic peptide
WGQGTLVTVSS

SEQ ID NO: 16464 - protein, 11 aa, Artificial Sequence
  Description of Artificial Sequence: Synthetic peptide
WGQGTLVTVSS

SEQ ID NO: 16465 - protein, 11 aa, Artificial Sequence
  Description of Artificial Sequence: Synthetic peptide
WGQGTLVTVSS

SEQ ID NO: 16466 - protein, 11 aa, Artificial Sequence
  Description of Artificial Sequence: Synthetic peptide
WGQGTLVTVSS

SEQ ID NO: 16467 - protein, 11 aa, Artificial Sequence
  Description of Artificial Sequence: Synthetic peptide
WGQGTLVTVSS

SEQ ID NO: 16468 - protein, 11 aa, Artificial Sequence
  Description of Artificial Sequence: Synthetic peptide
WGQGTLVTVSS

SEQ ID NO: 16469 - protein, 11 aa, Artificial Sequence
  Description of Artificial Sequence: Synthetic peptide
WGQGTLVTVSS

SEQ ID NO: 16470 - protein, 11 aa, Artificial Sequence
  Description of Artificial Sequence: Synthetic peptide
WGQGTLVTVSS

SEQ ID NO: 16471 - protein, 11 aa, Artificial Sequence
  Description of Artificial Sequence: Synthetic peptide
WGQGTLVTVSS

SEQ ID NO: 16472 - protein, 11 aa, Artificial Sequence
  Description of Artificial Sequence: Synthetic peptide
WGQGTLVTVSS

SEQ ID NO: 16473 - protein, 11 aa, Artificial Sequence
  Description of Artificial Sequence: Synthetic peptide
WGQGTLVTVSS

SEQ ID NO: 16474 - protein, 11 aa, Artificial Sequence
  Description of Artificial Sequence: Synthetic peptide
WGQGTLVTVSS

SEQ ID NO: 16475 - protein, 11 aa, Artificial Sequence
  Description of Artificial Sequence: Synthetic peptide
WGQGTLVTVSS

SEQ ID NO: 16476 - protein, 11 aa, Artificial Sequence
  Description of Artificial Sequence: Synthetic peptide
WGQGTLVTVSS

SEQ ID NO: 16477 - protein, 11 aa, Artificial Sequence
  Description of Artificial Sequence: Synthetic peptide
WGQGTLVTVSS

SEQ ID NO: 16478 - protein, 11 aa, Artificial Sequence
  Description of Artificial Sequence: Synthetic peptide
WGQGTLVTVSS

SEQ ID NO: 16479 - protein, 11 aa, Artificial Sequence
  Description of Artificial Sequence: Synthetic peptide
WGQGTLVTVSS

SEQ ID NO: 16480 - protein, 11 aa, Artificial Sequence
  Description of Artificial Sequence: Synthetic peptide
WGQGTLVTVSS

SEQ ID NO: 16481 - protein, 11 aa, Artificial Sequence
  Description of Artificial Sequence: Synthetic peptide
WGQGTLVTVSS

SEQ ID NO: 16482 - protein, 11 aa, Artificial Sequence
  Description of Artificial Sequence: Synthetic peptide
WGQGTLVTVSS

SEQ ID NO: 16483 - protein, 11 aa, Artificial Sequence
  Description of Artificial Sequence: Synthetic peptide
WGQGTLVTVSS

SEQ ID NO: 16484 - protein, 11 aa, Artificial Sequence
  Description of Artificial Sequence: Synthetic peptide
WGQGTLVTVSS

SEQ ID NO: 16485 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctccggattcacctttagcagccatgccatgagctgggtccgccaggctccagggaaggggctggagtgggtctcgtctattagtggtagcggtggtggcacatactacgcagcctccgtgaagggccggttcaccatctccagagacaattccaagaacacgctgtatctgcaaatgaacagc

SEQ ID NO: 16486 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSSISGSGGGTYYAASVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGGGTKLTVL

SEQ ID NO: 16487 - DNA, 255 bp, Artificial Sequence; identical to SEQ ID NO: 7101
  Description of Artificial Sequence: Synthetic polynucleotide

SEQ ID NO: 16488 - protein, 241 aa, Artificial Sequence
  Description of Artificial Sequence: Synthetic polypeptide
EVQLLESGGGLVKPGGSLRLSCAASGFTFSDYYMSWIRQAPGKGLEWVSYISKSGSTIYYADSVKGRFTISRDNAKNSLYLQMNSLRAEDTAVYYCATYNYGHFDYWGQGTLVTVSSGGGGSGGGGSGGGGSELVLTQPPSVSVAPGQTARITCGGNNIGSKSVHWYQQKPGQAPVLVVYDDSDRPSGIPERFSGSNSGNTATLTISRVEAGDEADYYCQVWDSSLSYGTVFGGGTKLTVL

SEQ ID NO: 16489 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagccatgccatgagctgggtccgccaggctccagggaaggggctggagtgggtctcaactattagtggaagtggtggtggcacatactacgcagactccgtgaagggccggttcaccatctccagagacaattccaagaacacgctgtatctgcaaatgaacagc

SEQ ID NO: 16490 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSTISGSGGGTYYADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGGGTKLTVL

SEQ ID NO: 16491 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcacctttagcagccatgccatgagctgggtccgccaggctccagggaaggggctggagtgggtctcagctattagtggaagtggtggtggcacatacaacgcagactccgtgaagggccggttcaccatctccagagacaattccaagaacacgctgtatctgcaaatgaacagc

SEQ ID NO: 16492 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAAYYCVTGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYYCQVWDYYSNRAVFGGGTKLTVL

SEQ ID NO: 16493 - DNA, 255 bp, Artificial Sequence
  Description of Artificial Sequence: Synthetic polynucleotide
gaggtgcagctgctcgagtccgggggaggcttggtaaagcctggggggtccctgagactctcctgtgcagcctctggattcaccttcagtgactactacatgagctggatccgccaggctccagggaaggggctggagtgggtttcatacattagtaaaagtagctacaccgtcacgtacgcagactctgtgaagggccgattcaccatctccagggacaacgccaagaactcactgtatctgcaaatgaacagc

SEQ ID NO: 16494 - protein, 241 aa, Artificial Sequence
  Description of Artificial Sequence: Synthetic polypeptide
EVQLLESGGGLVKPGGSLRLSCAASGFTFSDYYMSWIRQAPGKGLEWVSYISKSSYTVTYADSVKGRFTISRDNAKNSLYLQMNSLRAEDTAVYYCATYNYGHFDYWGQGTLVTVSSGGGGSGGGGSGGGGSELVLTQPPSVSVAPGQTARITCGGNNIGSKSVHWYQQKPGQAPVLVVYDDSDRPSGIPERFSGSNSGNTATLTISRVEAGDEADYYCQVWDASAGYGVVFGGGTKLTVL

SEQ ID NO: 16495 - DNA, 255 bp, Artificial Sequence; identical to SEQ ID NO: 7119
  Description of Artificial Sequence: Synthetic polynucleotide

SEQ ID NO: 16496 - protein, 242 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGGTYYADSVKGRFTISRDNSKNTLYLQMSSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGGGTKLTVL

SEQ ID NO: 16497 - DNA, 255 bp, Artificial Sequence
  Description of Artificial Sequence: Synthetic polynucleotide
gaggtgcagctgctcgagtccgggggaggcttggtacagcctggggggtcccttagactctcctgtgcagcctctggattcactttcagtaacgcctggatgagctgggtccgccaggctccagggaaggggctggagtgggttggccgtattaaaagcaaaacttatggtgggacaacagactacgctgcacccgtgaaaggcagattcaccatctcaagagatgattcaaaaaacacgctgtttctgcaaatg

SEQ ID NO: 16498 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIKSKTYGGTTDYAAPVKGRFTISRDDSKNTLFLQMNSLKTEDTAVYYCTTPSYSGSYYNYFSVMDVWGQGTTVTVSSGGGGSGGGGSGGGGSELVMTQSPSSLSASVGDRVTITCRTSQSISSYLNWYQQKPGRAPKLLIFAASSLQGGVPSRFSGSGSGTDFTLTISSLQPEDFATYYCQQSYSSPFTFGPGTKVEIK

SEQ ID NO: 16499 - DNA, 255 bp, Artificial Sequence; identical to SEQ ID NO: 7139
  Description of Artificial Sequence: Synthetic polynucleotide

SEQ ID NO: 16500 - protein, 245 aa, Artificial Sequence
  Description of Artificial Sequence: Synthetic polypeptide
EVQLLESGPALVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSELQMTQSPSSLSASVGDRVTITCQASQDISNYLNWYQQKPGKAPKLLIYAASSLQSGVPSRFSGRGSGTDFTLTISSLQPEDFATYYCQQSYYYPTLFGPGTKVEIK

SEQ ID NO: 16501 - DNA, 255 bp, Artificial Sequence
  Description of Artificial Sequence: Synthetic polynucleotide
gaggtgcagctgctcgagtctggtcctacgctggtgaaacccacacagaccctcacgctgacctgcaccttctctggtttctcattcaccactcataaaatgggtgtggactggatccgtcagcccccaggaaaggccctggagtggcttgcagggatccacatctacgatgataagcgctacagcccatctctgcagagtaggctcaccatcaccaaggacacctccaaaaaccaggtggtcctcacaatgacc

SEQ ID NO: 16502 - protein, 245 aa, Artificial Sequence
  Description of Artificial Sequence: Synthetic polypeptide
EVQLLESGPTLVKPTQTLTLTCTFSGFSFTTHKMGVDWIRQPPGKALEWLAGIHIYDDKRYSPSLQSRLTITKDTSKNQVVLTMTNMDPVDTATYYCAYRRYNWNYENWFDPWGQGTLVTVSSGGGGSGGGGSGGGGSELQMTQSPSSLSASVGDRVTITCQASQDISNYFNWYQQKPGKAPKLLIYAASSLQSGVPSRFSGSGSGTDFTLTISSLQPEDFATYYCQQSYITPFTFGPGTKVEIK

SEQ ID NO: 16503 - DNA, 255 bp, Artificial Sequence; identical to SEQ ID NO: 7139
  Description of Artificial Sequence: Synthetic polynucleotide

SEQ ID NO: 16504 - protein, 245 aa, Artificial Sequence
  Description of Artificial Sequence: Synthetic polypeptide
EVQLLESGPALVKPTQTLTLTCTFSGFSFTTHKMGVDWIRQPPGKALEWLALIYWNDDKRYSPSLQSRLTITKDTSKNQVVLTMTNMDPVDTATYYCAYRRYNWNYENWFDPWGQGTLVTVSSGGGGSGGGGSGGGGSELQMTQSPSSLSASVGDRVTITCQASQDISNYLNWYQQKPGKAPKLLIYAASSLQSGVPSRFSGSGSGTDFTLTISSLQPEDFATYYCQQSYFPVVEFGPGTKVEIK

SEQ ID NO: 16505 - DNA, 255 bp, Artificial Sequence; identical to SEQ ID NO: 7035
  Description of Artificial Sequence: Synthetic polynucleotide

SEQ ID NO: 16506 - protein, 242 aa, Artificial Sequence
  Description of Artificial Sequence: Synthetic polypeptide
EVQLLESGGGLVQPGGSLRLSCAASGFTFSSHAMSWVRQAPGKGLEWVSAISGSGGGTYNADSVKGRFTISRDNSKNTLYLQMNSLRAEDTAVYYCATGKGVHLGFDYWGQGTLVTVSSGGGGSGGGGSGGGGSELVLTQPPSVSVAPGQTARITCGGNNIGSKSVHWYQQKPGQAPVMVVYDDNDRPSGIPERFSGSNSGNTATLTISRVEAGDEADYYCQVWDYVAPRHVFGGGTKLTVL

SEQ ID NO: 16507 - DNA, 255 bp, Artificial Sequence
  Description of Artificial Sequence: Synthetic polynucleotide
gaggtgcagctgctcgagtccgggggaggcttggtacagcctggggggtcccttagactctcctgtgcagcctctggattcactttcagtaacgcctggatgagctgggtccgccaggctccagggaaggggttggagtgggttggccgcattacgtccggcatctatggtgggacaacagactacgctgcacccgtgaaaggcagattcaccatctcaagagatgattcaaaaaacacgctgtatctgcaaatg

SEQ ID NO: 16508 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRITSGIYGGTTDYAAPVKGRFTISRDDSKNTLYLQMNSLKTEDTAVYYCTTPSYSGSYYNYFSVMDVWGQGTTVTVSSGGGGSGGGGSGGGGSELVMTQSPSSLSASVGDRVTITCRTSQSISSYLNWYQQKPGRAPKLLIFAASSLQSGVPSRFSGSGSGTDFTLTISSLQPEDFATYYCQQTYSMPFTFGPGTKVDIK

SEQ ID NO: 16509 - DNA, 255 bp, Artificial Sequence
  Description of Artificial Sequence: Synthetic polynucleotide
gaggtgcagctgctcgagtccgggggaggcttggtacagcctggggggtccctgagactctcctgtgcagcctctggattcactttcagtaacgcctggatgagctgggtccgccaggctccagggaaggggctggagtgggttggccggattaggagcaggccctatggtgggacaacagactacgctgcacccgtgaaaggcagattcaccatctcaagagatgattcaaaaaacacgctgtatctgcaaatg

SEQ ID NO: 16510 - protein, 249 aa, Artificial Sequence
  Description of Artificial Sequence: Synthetic polypeptide
EVQLLESGGGLVQPGGSLRLSCAASGFTFSNAWMSWVRQAPGKGLEWVGRIRSRPYGGTTDYAAPVKGRFTISRDDSKNTLYLQMNSLKTEDTAVYYCTTPSYSGSYYNYFSVMDVWGQGTTVTVSSGGGGSGGGGSGGGGSELQMTQSPSSLSASVGDRVTITCRTSQSISSYLNWYQQKPGRAPKLLIFAASSLQGGVPSRFSGSGSGTDFTLTISSLQPEDFATYYCQQTYSSPFTFGPGTKLEIK

SEQ ID NO: 16511 - DNA, 33 bp, Artificial Sequence; identical to SEQ ID NO: 7385
  Description of Artificial Sequence: Synthetic oligonucleotide

SEQ ID NO: 16512 - protein, 11 aa, Artificial Sequence
  Description of Artificial Sequence: Synthetic peptide
GGNNIGSKSVH

SEQ ID NO: 16513 - DNA, 33 bp, Artificial Sequence; identical to SEQ ID NO: 7385
  Description of Artificial Sequence: Synthetic oligonucleotide

SEQ ID NO: 16514 - protein, 11 aa, Artificial Sequence
  Description of Artificial Sequence: Synthetic peptide
GGNNIGSKSVH

SEQ ID NO: 16515 - DNA, 33 bp, Artificial Sequence; identical to SEQ ID NO: 7385
  Description of Artificial Sequence: Synthetic oligonucleotide

SEQ ID NO: 16516 - protein, 11 aa, Artificial Sequence
  Description of Artificial Sequence: Synthetic peptide
GGNNIGSKSVH

SEQ ID NO: 16517 - DNA, 33 bp, Artificial Sequence; identical to SEQ ID NO: 7385
  Description of Artificial Sequence: Synthetic oligonucleotide

SEQ ID NO: 16518 - protein, 11 aa, Artificial Sequence
  Description of Artificial Sequence: Synthetic peptide
GGNNIGSKSVH

SEQ ID NO: 16519 - DNA, 33 bp, Artificial Sequence; identical to SEQ ID NO: 7385
  Description of Artificial Sequence: Synthetic oligonucleotide

SEQ ID NO: 16520 - protein, 11 aa, Artificial Sequence
  Description of Artificial Sequence: Synthetic peptide
GGNNIGSKSVH

SEQ ID NO: 16521 - DNA, 33 bp, Artificial Sequence; identical to SEQ ID NO: 7385
  Description of Artificial Sequence: Synthetic oligonucleotide

SEQ ID NO: 16522 - protein, 11 aa, Artificial Sequence
  Description of Artificial Sequence: Synthetic peptide
GGNNIGSKSVH

SEQ ID NO: 16523 - DNA, 33 bp, Artificial Sequence; identical to SEQ ID NO: 7355
  Description of Artificial Sequence: Synthetic oligonucleotide

SEQ ID NO: 16524 - protein, 11 aa, Artificial Sequence
  Description of Artificial Sequence: Synthetic peptide
RTSQSISSYLN

SEQ ID NO: 16525 - DNA, 33 bp, Artificial Sequence; identical to SEQ ID NO: 7283
  Description of Artificial Sequence: Synthetic oligonucleotide

SEQ ID NO: 16526 - protein, 11 aa, Artificial Sequence
  Description of Artificial Sequence: Synthetic peptide
QASQDISNYLN

SEQ ID NO: 16527 - DNA, 33 bp, Artificial Sequence
  Description of Artificial Sequence: Synthetic oligonucleotide
caggcgagtcaggacattagcaactatttcaat

SEQ ID NO: 16528 - protein, 11 aa, Artificial Sequence
  Description of Artificial Sequence: Synthetic peptide
QASQDISNYFN

SEQ ID NO: 16529 - DNA, 33 bp, Artificial Sequence; identical to SEQ ID NO: 7283
  Description of Artificial Sequence: Synthetic oligonucleotide

SEQ ID NO: 16530 - protein, 11 aa, Artificial Sequence
  Description of Artificial Sequence: Synthetic peptide
QASQDISNYLN

SEQ ID NO: 16531 - DNA, 33 bp, Artificial Sequence; identical to SEQ ID NO: 7385
  Description of Artificial Sequence: Synthetic oligonucleotide

SEQ ID NO: 16532 - protein, 11 aa, Artificial Sequence
  Description of Artificial Sequence: Synthetic peptide
GGNNIGSKSVH

SEQ ID NO: 16533 - DNA, 33 bp, Artificial Sequence; identical to SEQ ID NO: 7355
  Description of Artificial Sequence: Synthetic oligonucleotide

SEQ ID NO: 16534 - protein, 11 aa, Artificial Sequence
  Description of Artificial Sequence: Synthetic peptide
RTSQSISSYLN

SEQ ID NO: 16535 - DNA, 33 bp, Artificial Sequence; identical to SEQ ID NO: 7355
  Description of Artificial Sequence: Synthetic oligonucleotide

SEQ ID NO: 16536 - protein, 11 aa, Artificial Sequence
  Description of Artificial Sequence: Synthetic peptide
RTSQSISSYLN

SEQ ID NO: 16537 - DNA, 15 bp, Artificial Sequence
  Description of Artificial Sequence: Synthetic oligonucleotide
agccatgccatgagc

SEQ ID NO: 16538 - protein, 5 aa, Artificial Sequence
  Description of Artificial Sequence: Synthetic peptide
SHAMS

SEQ ID NO: 16539 - DNA, 15 bp, Artificial Sequence
  Description of Artificial Sequence: Synthetic oligonucleotide
gactactacatgagc

SEQ ID NO: 16540 - protein, 5 aa, Artificial Sequence
  Description of Artificial Sequence: Synthetic peptide
DYYMS

SEQ ID NO: 16541 - DNA, 15 bp, Artificial Sequence
  Description of Artificial Sequence: Synthetic oligonucleotide
agccatgccatgagc

SEQ ID NO: 16542 - protein, 5 aa, Artificial Sequence
  Description of Artificial Sequence: Synthetic peptide
SHAMS

SEQ ID NO: 16543 - DNA, 15 bp, Artificial Sequence
  Description of Artificial Sequence: Synthetic oligonucleotide
agccatgccatgagc

SEQ ID NO: 16544 - protein, 5 aa, Artificial Sequence
  Description of Artificial Sequence: Synthetic peptide
SHAMS

SEQ ID NO: 16545 - DNA, 15 bp, Artificial Sequence
  Description of Artificial Sequence: Synthetic oligonucleotide
gactactacatgagc

SEQ ID NO: 16546 - protein, 5 aa, Artificial Sequence
  Description of Artificial Sequence: Synthetic peptide
DYYMS

SEQ ID NO: 16547 - DNA, 15 bp, Artificial Sequence
  Description of Artificial Sequence: Synthetic oligonucleotide
agctatgccatgagc

SEQ ID NO: 16548 - protein, 5 aa, Artificial Sequence
  Description of Artificial Sequence: Synthetic peptide
SYAMS

SEQ ID NO: 16549 - DNA, 15 bp, Artificial Sequence
  Description of Artificial Sequence: Synthetic oligonucleotide
aacgcctggatgagc

SEQ ID NO: 16550 - protein, 5 aa, Artificial Sequence
  Description of Artificial Sequence: Synthetic peptide
NAWMS

SEQ ID NO: 16551 - DNA, 21 bp, Artificial Sequence
  Description of Artificial Sequence: Synthetic oligonucleotide
actcataaaatgggtgtggac

SEQ ID NO: 16552 - protein, 7 aa, Artificial Sequence
  Description of Artificial Sequence: Synthetic peptide
THKMGVD

SEQ ID NO: 16553 - DNA, 21 bp, Artificial Sequence
  Description of Artificial Sequence: Synthetic oligonucleotide
actcataaaatgggtgtggac

SEQ ID NO: 16554 - protein, 7 aa, Artificial Sequence
  Description of Artificial Sequence: Synthetic peptide
THKMGVD

SEQ ID NO: 16555 - DNA, 21 bp, Artificial Sequence
  Description of Artificial Sequence: Synthetic oligonucleotide
actcataaaatgggtgtggac

SEQ ID NO: 16556 - protein, 7 aa, Artificial Sequence
  Description of Artificial Sequence: Synthetic peptide
THKMGVD

SEQ ID NO: 16557 - DNA, 15 bp, Artificial Sequence
  Description of Artificial Sequence: Synthetic oligonucleotide
agccatgccatgagc

SEQ ID NO: 16558 - protein, 5 aa, Artificial Sequence
  Description of Artificial Sequence: Synthetic peptide
SHAMS

SEQ ID NO: 16559 - DNA, 15 bp, Artificial Sequence
  Description of Artificial Sequence: Synthetic oligonucleotide
aacgcctggatgagc

SEQ ID NO: 16560 - protein, 5 aa, Artificial Sequence
  Description of Artificial Sequence: Synthetic peptide
NAWMS

SEQ ID NO: 16561 - DNA, 15 bp, Artificial Sequence
  Description of Artificial Sequence: Synthetic oligonucleotide
aacgcctggatgagc

SEQ ID NO: 16562 - protein, 5 aa, Artificial Sequence
  Description of Artificial Sequence: Synthetic peptide
NAWMS

SEQ ID NO: 16563 - DNA, 21 bp, Artificial Sequence
  Description of Artificial Sequence: Synthetic oligonucleotide
gatgataacgaccggccctca

SEQ ID NO: 16564 - protein, 7 aa, Artificial Sequence
  Description of Artificial Sequence: Synthetic peptide
DDNDRPS

SEQ ID NO: 16565 - DNA, 21 bp, Artificial Sequence
  Description of Artificial Sequence: Synthetic oligonucleotide
gatgatagcgaccggccctca

SEQ ID NO: 16566 - protein, 7 aa, Artificial Sequence
  Description of Artificial Sequence: Synthetic peptide
DDSDRPS

SEQ ID NO: 16567 - DNA, 21 bp, Artificial Sequence
  Description of Artificial Sequence: Synthetic oligonucleotide
gatgataacgaccggccctca

SEQ ID NO: 16568 - protein, 7 aa, Artificial Sequence
  Description of Artificial Sequence: Synthetic peptide
DDNDRPS

SEQ ID NO: 16569 - DNA, 21 bp, Artificial Sequence
  Description of Artificial Sequence: Synthetic oligonucleotide
gatgataacgaccggccctca

SEQ ID NO: 16570 - protein, 7 aa, Artificial Sequence
  Description of Artificial Sequence: Synthetic peptide
DDNDRPS

SEQ ID NO: 16571 - DNA, 21 bp, Artificial Sequence
  Description of Artificial Sequence: Synthetic oligonucleotide
gatgatagcgaccggccctca

SEQ ID NO: 16572 - protein, 7 aa, Artificial Sequence
  Description of Artificial Sequence: Synthetic peptide
DDSDRPS

SEQ ID NO: 16573 - DNA, 21 bp, Artificial Sequence
  Description of Artificial Sequence: Synthetic oligonucleotide
gatgataacgaccggccctca

SEQ ID NO: 16574 - protein, 7 aa, Artificial Sequence
  Description of Artificial Sequence: Synthetic peptide
DDNDRPS

SEQ ID NO: 16575 - DNA, 21 bp, Artificial Sequence
  Description of Artificial Sequence: Synthetic oligonucleotide
gctgcatccagtttgcaaggt

SEQ ID NO: 16576 - protein, 7 aa, Artificial Sequence
  Description of Artificial Sequence: Synthetic peptide
AASSLQG

SEQ ID NO: 16577 - DNA, 21 bp, Artificial Sequence
  Description of Artificial Sequence: Synthetic oligonucleotide
gctgcatccagtttgcaaagt

SEQ ID NO: 16578 - protein, 7 aa, Artificial Sequence
  Description of Artificial Sequence: Synthetic peptide
AASSLQS

SEQ ID NO: 16579 - DNA, 21 bp, Artificial Sequence
  Description of Artificial Sequence: Synthetic oligonucleotide
gctgcatccagtttgcaaagt

SEQ ID NO: 16580 - protein, 7 aa, Artificial Sequence
  Description of Artificial Sequence: Synthetic peptide
AASSLQS

SEQ ID NO: 16581 - DNA, 21 bp, Artificial Sequence
  Description of Artificial Sequence: Synthetic oligonucleotide
gctgcatccagtttgcaaagt

SEQ ID NO: 16582 - protein, 7 aa, Artificial Sequence
  Description of Artificial Sequence: Synthetic peptide
AASSLQS

SEQ ID NO: 16583 - DNA, 21 bp, Artificial Sequence
  Description of Artificial Sequence: Synthetic oligonucleotide
gatgataacgaccggccctca

SEQ ID NO: 16584 - protein, 7 aa, Artificial Sequence
  Description of Artificial Sequence: Synthetic peptide
DDNDRPS

SEQ ID NO: 16585 - DNA, 21 bp, Artificial Sequence
  Description of Artificial Sequence: Synthetic oligonucleotide
gctgcatccagtttgcaaagt

SEQ ID NO: 16586 - protein, 7 aa, Artificial Sequence
  Description of Artificial Sequence: Synthetic peptide
AASSLQS

SEQ ID NO: 16587 - DNA, 21 bp, Artificial Sequence
  Description of Artificial Sequence: Synthetic oligonucleotide
gctgcatccagtttgcaaggt

SEQ ID NO: 16588 - protein, 7 aa, Artificial Sequence
  Description of Artificial Sequence: Synthetic peptide
AASSLQG

SEQ ID NO: 16589 - DNA, 51 bp, Artificial Sequence; identical to SEQ ID NO: 8549
  Description of Artificial Sequence: Synthetic oligonucleotide

SEQ ID NO: 16590 - protein, 17 aa, Artificial Sequence
  Description of Artificial Sequence: Synthetic peptide
SISGSGGGTYYAASVKG

SEQ ID NO: 16591 - DNA, 51 bp, Artificial Sequence; identical to SEQ ID NO: 8533
  Description of Artificial Sequence: Synthetic oligonucleotide

SEQ ID NO: 16592 - protein, 17 aa, Artificial Sequence
  Description of Artificial Sequence: Synthetic peptide
YISKSGSTIYYADSVKG

SEQ ID NO: 16593 - DNA, 51 bp, Artificial Sequence; identical to SEQ ID NO: 8463
  Description of Artificial Sequence: Synthetic oligonucleotide

SEQ ID NO: 16594 - protein, 17 aa, Artificial Sequence
  Description of Artificial Sequence: Synthetic peptide
TISGSGGGTYYADSVKG

SEQ ID NO: 16595 - DNA, 51 bp, Artificial Sequence
  Description of Artificial Sequence: Synthetic oligonucleotide
gctattagtggaagtggtggtggcacatacaacgcagactccgtgaagggc

SEQ ID NO: 16596 - protein, 17 aa, Artificial Sequence
  Description of Artificial Sequence: Synthetic peptide
AISGSGGGTYNADSVKG

SEQ ID NO: 16597 - DNA, 51 bp, Artificial Sequence
  Description of Artificial Sequence: Synthetic oligonucleotide
tacattagtaaaagtagctacaccgtcacgtacgcagactctgtgaagggc

SEQ ID NO: 16598 - protein, 17 aa, Artificial Sequence
  Description of Artificial Sequence: Synthetic peptide
YISKSSYTVTYADSVKG

SEQ ID NO: 16599 - DNA, 51 bp, Artificial Sequence; identical to SEQ ID NO: 8465
  Description of Artificial Sequence: Synthetic oligonucleotide

SEQ ID NO: 16600 - protein, 17 aa, Artificial Sequence
  Description of Artificial Sequence: Synthetic peptide
AISGSGGGTYYADSVKG

SEQ ID NO: 16601 - DNA, 57 bp, Artificial Sequence; identical to SEQ ID NO: 8579
  Description of Artificial Sequence: Synthetic oligonucleotide

SEQ ID NO: 16602 - protein, 19 aa, Artificial Sequence
  Description of Artificial Sequence: Synthetic peptide
RIKSKTYGGTTDYAAPVKG

SEQ ID NO: 16603 - DNA, 48 bp, Artificial Sequence; identical to SEQ ID NO: 8395
  Description of Artificial Sequence: Synthetic oligonucleotide

SEQ ID NO: 16604 - protein, 16 aa, Artificial Sequence
  Description of Artificial Sequence: Synthetic peptide
LIYWNDDKRYSPSLQS

SEQ ID NO: 16605 - DNA, 48 bp, Artificial Sequence
  Description of Artificial Sequence: Synthetic oligonucleotide
gggatccacatctacgatgataagcgctacagcccatctctgcagagt

SEQ ID NO: 16606 - protein, 16 aa, Artificial Sequence
  Description of Artificial Sequence: Synthetic peptide
GIHIYDDKRYSPSLQS

SEQ ID NO: 16607 - DNA, 48 bp, Artificial Sequence; identical to SEQ ID NO: 8395
  Description of Artificial Sequence: Synthetic oligonucleotide

SEQ ID NO: 16608 - protein, 16 aa, Artificial Sequence
  Description of Artificial Sequence: Synthetic peptide
LIYWNDDKRYSPSLQS

SEQ ID NO: 16609 - DNA, 51 bp, Artificial Sequence; identical to SEQ ID NO: 8467
  Description of Artificial Sequence: Synthetic oligonucleotide

SEQ ID NO: 16610 - protein, 17 aa, Artificial Sequence
  Description of Artificial Sequence: Synthetic peptide
AISGSGGGTYNADSVKG

SEQ ID NO: 16611 - DNA, 57 bp, Artificial Sequence
  Description of Artificial Sequence: Synthetic oligonucleotide
cgcattacgtccggcatctatggtgggacaacagactacgctgcacccgtgaaaggc

SEQ ID NO: 16612 - protein, 19 aa, Artificial Sequence
  Description of Artificial Sequence: Synthetic peptide
RITSGIYGGTTDYAAPVKG

SEQ ID NO: 16613 - DNA, 57 bp, Artificial Sequence
  Description of Artificial Sequence: Synthetic oligonucleotide
cggattaggagcaggccctatggtgggacaacagactacgctgcacccgtgaaaggc

SEQ ID NO: 16614 - protein, 19 aa, Artificial Sequence
  Description of Artificial Sequence: Synthetic peptide
RIRSRPYGGTTDYAAPVKG

SEQ ID NO: 16615 - DNA, 33 bp, Artificial Sequence
  Description of Artificial Sequence: Synthetic oligonucleotide
caggtgtgggattatagccccttgaggcacgta

SEQ ID NO: 16616 - protein, 11 aa, Artificial Sequence
  Description of Artificial Sequence: Synthetic peptide
QVWDYSPLRHV

SEQ ID NO: 16617 - DNA, 36 bp, Artificial Sequence
  Description of Artificial Sequence: Synthetic oligonucleotide
caggtgtgggactctagtctgtcctacgggacggta

SEQ ID NO: 16618 - protein, 12 aa, Artificial Sequence
  Description of Artificial Sequence: Synthetic peptide
QVWDSSLSYGTV

SEQ ID NO: 16619 - DNA, 33 bp, Artificial Sequence
  Description of Artificial Sequence: Synthetic oligonucleotide
caggtgtgggattatcgcacgctcgactgggta

SEQ ID NO: 16620 - protein, 11 aa, Artificial Sequence
  Description of Artificial Sequence: Synthetic peptide
QVWDYRTLDWV

SEQ ID NO: 16621 - DNA, 33 bp, Artificial Sequence
  Description of Artificial Sequence: Synthetic oligonucleotide
caggtgtgggattattactccaacagggccgta

SEQ ID NO: 16622 - protein, 11 aa, Artificial Sequence
  Description of Artificial Sequence: Synthetic peptide
QVWDYYSNRAV

SEQ ID NO: 16623 - DNA, 36 bp, Artificial Sequence
  Description of Artificial Sequence: Synthetic oligonucleotide
caggtgtgggacgctagtgcggggtacggggtcgta

SEQ ID NO: 16624 - protein, 12 aa, Artificial Sequence
  Description of Artificial Sequence: Synthetic peptide
QVWDASAGYGVV

SEQ ID NO: 16625 - DNA, 33 bp, Artificial Sequence
  Description of Artificial Sequence: Synthetic oligonucleotide
caggtgtgggattattcggggcagaggcaggta

SEQ ID NO: 16626 - protein, 11 aa, Artificial Sequence
  Description of Artificial Sequence: Synthetic peptide
QVWDYSGQRQV

SEQ ID NO: 16627 - DNA, 27 bp, Artificial Sequence
  Description of Artificial Sequence: Synthetic oligonucleotide
caacagagttacagtagtccattcact

SEQ ID NO: 16628 - protein, 9 aa, Artificial Sequence
  Description of Artificial Sequence: Synthetic peptide
QQSYSSPFT

SEQ ID NO: 16629 - DNA, 27 bp, Artificial Sequence
  Description of Artificial Sequence: Synthetic oligonucleotide
caacagagttactactaccccaccctc

SEQ ID NO: 16630 - protein, 9 aa, Artificial Sequence
  Description of Artificial Sequence: Synthetic peptide
QQSYYYPTL

SEQ ID NO: 16631 - DNA, 27 bp, Artificial Sequence
  Description of Artificial Sequence: Synthetic oligonucleotide
caacagagttacattaccccgttcact

SEQ ID NO: 16632 - protein, 9 aa, Artificial Sequence
  Description of Artificial Sequence: Synthetic peptide
QQSYITPFT

SEQ ID NO: 16633 - DNA, 27 bp, Artificial Sequence
  Description of Artificial Sequence: Synthetic oligonucleotide
caacagagttacttccccgtcgtcgag

SEQ ID NO: 16634 - protein, 9 aa, Artificial Sequence
  Description of Artificial Sequence: Synthetic peptide
QQSYFPVVE

SEQ ID NO: 16635 - DNA, 33 bp, Artificial Sequence
  Description of Artificial Sequence: Synthetic oligonucleotide
caggtgtgggattatgtggcgccgaggcacgta

SEQ ID NO: 16636 - protein, 11 aa, Artificial Sequence
  Description of Artificial Sequence: Synthetic peptide
QVWDYVAPRHV

SEQ ID NO: 16637 - DNA, 27 bp, Artificial Sequence
  Description of Artificial Sequence: Synthetic oligonucleotide
caacagacttacagtatgccattcact

SEQ ID NO: 16638 - protein, 9 aa, Artificial Sequence
  Description of Artificial Sequence: Synthetic peptide
QQTYSMPFT

SEQ ID NO: 16639 - DNA, 27 bp, Artificial Sequence
  Description of Artificial Sequence: Synthetic oligonucleotide
caacagacttacagtagtccattcact

SEQ ID NO: 16640 - protein, 9 aa, Artificial Sequence
  Description of Artificial Sequence: Synthetic peptide
QQTYSSPFT

SEQ ID NO: 16641 - DNA, 30 bp, Artificial Sequence; identical to SEQ ID NO: 9175
  Description of Artificial Sequence: Synthetic oligonucleotide

SEQ ID NO: 16642 - protein, 10 aa, Artificial Sequence
  Description of Artificial Sequence: Synthetic peptide
GKGVHLGFDY

SEQ ID NO: 16643 - DNA, 24 bp, Artificial Sequence
  Description of Artificial Sequence: Synthetic oligonucleotide
tacaactatggtcactttgactac

SEQ ID NO: 16644 - protein, 8 aa, Artificial Sequence
  Description of Artificial Sequence: Synthetic peptide
YNYGHFDY

SEQ ID NO: 16645 - DNA, 30 bp, Artificial Sequence; identical to SEQ ID NO: 9175
  Description of Artificial Sequence: Synthetic oligonucleotide

SEQ ID NO: 16646 - protein, 10 aa, Artificial Sequence
  Description of Artificial Sequence: Synthetic peptide
GKGVHLGFDY

SEQ ID NO: 16647 - DNA, 30 bp, Artificial Sequence; identical to SEQ ID NO: 9175
  Description of Artificial Sequence: Synthetic oligonucleotide

SEQ ID NO: 16648 - protein, 10 aa, Artificial Sequence
  Description of Artificial Sequence: Synthetic peptide
GKGVHLGFDY

SEQ ID NO: 16649 - DNA, 24 bp, Artificial Sequence
  Description of Artificial Sequence: Synthetic oligonucleotide
tacaactatggtcactttgactac

SEQ ID NO: 16650 - protein, 8 aa, Artificial Sequence
  Description of Artificial Sequence: Synthetic peptide
YNYGHFDY

SEQ ID NO: 16651 - DNA, 30 bp, Artificial Sequence; identical to SEQ ID NO: 9175
  Description of Artificial Sequence: Synthetic oligonucleotide

SEQ ID NO: 16652 - protein, 10 aa, Artificial Sequence
  Description of Artificial Sequence: Synthetic peptide
GKGVHLGFDY

SEQ ID NO: 16653 - DNA, 48 bp, Artificial Sequence; identical to SEQ ID NO: 9147
  Description of Artificial Sequence: Synthetic oligonucleotide

SEQ ID NO: 16654 - protein, 16 aa, Artificial Sequence
  Description of Artificial Sequence: Synthetic peptide
PSYSGSYYNYFSVMDV

SEQ ID NO: 16655 - DNA, 39 bp, Artificial Sequence; identical to SEQ ID NO: 9093
  Description of Artificial Sequence: Synthetic oligonucleotide

SEQ ID NO: 16656 - protein, 13 aa, Artificial Sequence
  Description of Artificial Sequence: Synthetic peptide
RRYNWNYENWFDP

SEQ ID NO: 16657 - DNA, 39 bp, Artificial Sequence; identical to SEQ ID NO: 9093
  Description of Artificial Sequence: Synthetic oligonucleotide

SEQ ID NO: 16658 - protein, 13 aa, Artificial Sequence
  Description of Artificial Sequence: Synthetic peptide
RRYNWNYENWFDP

SEQ ID NO: 16659 - DNA, 39 bp, Artificial Sequence; identical to SEQ ID NO: 9093
  Description of Artificial Sequence: Synthetic oligonucleotide

SEQ ID NO: 16660 - protein, 13 aa, Artificial Sequence
  Description of Artificial Sequence: Synthetic peptide
RRYNWNYENWFDP

SEQ ID NO: 16661 - DNA, 30 bp, Artificial Sequence; identical to SEQ ID NO: 9175
  Description of Artificial Sequence: Synthetic oligonucleotide

SEQ ID NO: 16662 - protein, 10 aa, Artificial Sequence
  Description of Artificial Sequence: Synthetic peptide
GKGVHLGFDY

SEQ ID NO: 16663 - DNA, 48 bp, Artificial Sequence; identical to SEQ ID NO: 9147
  Description of Artificial Sequence: Synthetic oligonucleotide

SEQ ID NO: 16664 - protein, 16 aa, Artificial Sequence
  Description of Artificial Sequence: Synthetic peptide
PSYSGSYYNYFSVMDV

SEQ ID NO: 16665 - DNA, 48 bp, Artificial Sequence; identical to SEQ ID NO: 9147
  Description of Artificial Sequence: Synthetic oligonucleotide

SEQ ID NO: 16666 - protein, 16 aa, Artificial Sequence
  Description of Artificial Sequence: Synthetic peptide
PSYSGSYYNYFSVMDV

SEQ ID NO: 16667 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaacaacattggaagtaaaagtgtgcactggtaccaacagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 16668 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGGGTKLTVL

SEQ ID NO: 16669 - DNA, 255 bp, Artificial Sequence; identical to SEQ ID NO: 9607
  Description of Artificial Sequence: Synthetic polynucleotide

SEQ ID NO: 16670 - protein, 109 aa, Artificial Sequence
  Description of Artificial Sequence: Synthetic polypeptide
ELVLTQPPSVSVAPGQTARITCGGNNIGSKSVHWYQQKPGQAPVLVVYDDSDRPSGIPERFSGSNSGNTATLTISRVEAGDEADYYCQVWDSSLSYGTVFGGGTKLTVL

SEQ ID NO: 16671 - DNA, 255 bp, Artificial Sequence
  Description of Artificial Sequence: Synthetic polynucleotide
gagctcgtgctgactcagccaccctcggtgtcagtggccccaggacagacggccaggattacctgtgggggaaacaacattggaagtaaaagtgtgcactggtaccaacagaagccaggccaggcccctgtgatggtcgtctatgatgataacgaccggccctcagggatccctgagcgattctctggctccaactttgggaacacggccaccctgattatcagtagggtcgaagccggggatgaggccgactat

SEQ ID NO: 16672 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGGGTKLTVL

SEQ ID NO: 16673 - DNA, 255 bp, Artificial Sequence; identical to SEQ ID NO: 9617
  Description of Artificial Sequence: Synthetic polynucleotide

SEQ ID NO: 16674 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNSGNTATLTISRVEAGDEADYYCQVWDYYSNRAVFGGGTKLTVL

SEQ ID NO: 16675 - DNA, 255 bp, Artificial Sequence; identical to SEQ ID NO: 9607
  Description of Artificial Sequence: Synthetic polynucleotide

SEQ ID NO: 16676 - protein, 109 aa, Artificial Sequence
  Description of Artificial Sequence: Synthetic polypeptide
ELVLTQPPSVSVAPGQTARITCGGNNIGSKSVHWYQQKPGQAPVLVVYDDSDRPSGIPERFSGSNSGNTATLTISRVEAGDEADYYCQVWDASAGYGVVFGGGTKLTVL

SEQ ID NO: 16677 - DNA, 255 bp, Artificial Sequence
  Description of Artificial Sequence: Synthetic polynucleotide
gagctcgtgttgacgcagccgccctcggtgtcagtggccccaggacagacggccaggataacctgtgggggaaacaacattggaagtaaaagtgtgcactggtaccaacagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 16678 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGGGTKLTVL

SEQ ID NO: 16679 - DNA, 255 bp, Artificial Sequence; identical to SEQ ID NO: 9669
  Description of Artificial Sequence: Synthetic polynucleotide

SEQ ID NO: 16680 - protein, 107 aa, Artificial Sequence; identical to SEQ ID NO: 9670
  Description of Artificial Sequence: Synthetic polypeptide

SEQ ID NO: 16681 - DNA, 255 bp, Artificial Sequence
  Description of Artificial Sequence: Synthetic polynucleotide
gagctccagatgacccagtctccatcctccctgtctgcatctgtaggagacagagtcaccatcacttgccaggcgagtcaggacattagcaactatttaaattggtatcagcagaaaccagggaaagcccctaagctcctgatctatgctgcatccagtttgcaaagtggggtcccatcaaggttcagtggccgtggatctgggacagatttcactctcaccatcagcagtctgcaacctgaagattttgcaact

SEQ ID NO: 16682 - protein, 107 aa, Artificial Sequence
  Description of Artificial Sequence: Synthetic polypeptide
ELQMTQSPSSLSASVGDRVTITCQASQDISNYLNWYQQKPGKAPKLLIYAASSLQSGVPSRFSGRGSGTDFTLTISSLQPEDFATYYCQQSYYYPTLFGPGTKVEIK

SEQ ID NO: 16683 - DNA, 255 bp, Artificial Sequence
  Description of Artificial Sequence: Synthetic polynucleotide
gagctccagatgacccagtctccatcctccctgtctgcatctgtaggagacagagtcaccatcacttgccaggcgagtcaggacattagcaactatttcaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaact

SEQ ID NO: 16684 - protein, 107 aa, Artificial Sequence
  Description of Artificial Sequence: Synthetic polypeptide
ELQMTQSPSSLSASVGDRVTITCQASQDISNYFNWYQQKPGKAPKLLIYAASSLQSGVPSRFSGSGSGTDFTLTISSLQPEDFATYYCQQSYITPFTFGPGTKVEIK

SEQ ID NO: 16685 - DNA, 255 bp, Artificial Sequence; identical to SEQ ID NO: 9645
  Description of Artificial Sequence: Synthetic polynucleotide

SEQ ID NO: 16686 - protein, 107 aa, Artificial Sequence
  Description of Artificial Sequence: Synthetic polypeptide
ELQMTQSPSSLSASVGDRVTITCQASQDISNYLNWYQQKPGKAPKLLIYAASSLQSGVPSRFSGSGSGTDFTLTISSLQPEDFATYYCQQSYFPVVEFGPGTKVEIK

SEQ ID NO: 16687 - DNA, 255 bp, Artificial Sequence
  Description of Artificial Sequence: Synthetic polynucleotide
gagctcgtgttgacgcagccgccctcggtgtcagtggccccaggacagacggccaggattacctgtgggggaaacaacattggaagtaaaagtgtgcactggtaccaacagaagccaggccaggcccctgtgatggtcgtctatgatgataacgaccggccctcagggatccctgagcgattctctggctccaactctgggaacacggccaccctgaccatcagcagggtcgaagccggggatgaggccgactat

SEQ ID NO: 16688 - protein, 108 aa, Artificial Sequence
  Description of Artificial Sequence: Synthetic polypeptide
ELVLTQPPSVSVAPGQTARITCGGNNIGSKSVHWYQQKPGQAPVMVVYDDNDRPSGIPERFSGSNSGNTATLTISRVEAGDEADYYCQVWDYVAPRHVFGGGTKLTVL

SEQ ID NO: 16689 - DNA, 255 bp, Artificial Sequence
  Description of Artificial Sequence: Synthetic polynucleotide
gagctcgtgatgacccagtctccatcctccctgtctgcatctgtaggagacagagtcaccatcacttgccggacaagtcagagcattagcagctatttaaattggtatcagcagaaaccagggagagcccctaagctcctgatctttgctgcatccagtttgcaaagtggggtcccatcaaggttcagtggcagtggatctgggacagatttcactctcaccatcagcagtctccaacctgaagattttgcaact

SEQ ID NO: 16690 - protein, 107 aa, Artificial Sequence
  Description of Artificial Sequence: Synthetic polypeptide
ELVMTQSPSSLSASVGDRVTITCRTSQSISSYLNWYQQKPGRAPKLLIFAASSLQSGVPSRFSGSGSGTDFTLTISSLQPEDFATYYCQQTYSMPFTFGPGTKVDIK

SEQ ID NO: 16691 - DNA, 255 bp, Artificial Sequence; identical to SEQ ID NO: 9507
  Description of Artificial Sequence: Synthetic polynucleotide

SEQ ID NO: 16692 - protein, 107 aa, Artificial Sequence
  Description of Artificial Sequence: Synthetic polypeptide
ELQMTQSPSSLSASVGDRVTITCRTSQSISSYLNWYQQKPGRAPKLLIFAASSLQGGVPSRFSGSGSGTDFTLTISSLQPEDFATYYCQQTYSSPFTFGPGTKLEIK

SEQ ID NO: 16693 - DNA, 255 bp, Artificial Sequence; identical to SEQ ID NO: 16485
  Description of Artificial Sequence: Synthetic polynucleotide

SEQ ID NO: 16694 - protein, 119 aa, Artificial Sequence; identical to SEQ ID NO: 10045
  Description of Artificial Sequence: Synthetic polypeptide

SEQ ID NO: 16695 - DNA, 255 bp, Artificial Sequence; identical to SEQ ID NO: 7101
  Description of Artificial Sequence: Synthetic polynucleotide

SEQ ID NO: 16696 - protein, 117 aa, Artificial Sequence; identical to SEQ ID NO: 9966
  Description of Artificial Sequence: Synthetic polypeptide

SEQ ID NO: 16697 - DNA, 255 bp, Artificial Sequence; identical to SEQ ID NO: 16489
  Description of Artificial Sequence: Synthetic polynucleotide

SEQ ID NO: 16698 - protein, 119 aa, Artificial Sequence; identical to SEQ ID NO: 10046
  Description of Artificial Sequence: Synthetic polypeptide

SEQ ID NO: 16699 - DNA, 255 bp, Artificial Sequence; identical to SEQ ID NO: 16491
  Description of Artificial Sequence: Synthetic polynucleotide

SEQ ID NO: 16700 - protein, 119 aa, Artificial Sequence; identical to SEQ ID NO: 9900
  Description of Artificial Sequence: Synthetic polypeptide

SEQ ID NO: 16701 - DNA, 255 bp, Artificial Sequence; identical to SEQ ID NO: 16493
  Description of Artificial Sequence: Synthetic polynucleotide

SEQ ID NO: 16702 - protein, 117 aa, Artificial Sequence
  Description of Artificial Sequence: Synthetic polypeptide
EVQLLESGGGLVKPGGSLRLSCAASGFTFSDYYMSWIRQAPGKGLEWVSYISKSSYTVTYADSVKGRFTISRDNAKNSLYLQMNSLRAEDTAVYYCATYNYGHFDYWGQGTLVTVSS

SEQ ID NO: 16703 - DNA, 255 bp, Artificial Sequence; identical to SEQ ID NO: 7119
  Description of Artificial Sequence: Synthetic polynucleotide

SEQ ID NO: 16704 - protein, 119 aa, Artificial Sequence; identical to SEQ ID NO: 9938
  Description of Artificial Sequence: Synthetic polypeptide

SEQ ID NO: 16705 - DNA, 255 bp, Artificial Sequence; identical to SEQ ID NO: 16497
  Description of Artificial Sequence: Synthetic polynucleotide

SEQ ID NO: 16706 - protein, 127 aa, Artificial Sequence
  Description of Artificial Sequence: Synthetic polypeptide
EVQLLESGGGLVQPGGSLRLSCAASGFTFSNAWMSWVRQAPGKGLEWVGRIKSKTYGGTTDYAAPVKGRFTISRDDSKNTLFLQMNSLKTEDTAVYYCTTPSYSGSYYNYFSVMDVWGQGTTVTVSS

SEQ ID NO: 16707 - DNA, 255 bp, Artificial Sequence; identical to SEQ ID NO: 7139
  Description of Artificial Sequence: Synthetic polynucleotide

SEQ ID NO: 16708 - protein, 123 aa, Artificial Sequence; identical to SEQ ID NO: 10004
  Description of Artificial Sequence: Synthetic polypeptide

SEQ ID NO: 16709 - DNA, 255 bp, Artificial Sequence; identical to SEQ ID NO: 16501
  Description of Artificial Sequence: Synthetic polynucleotide

SEQ ID NO: 16710 - protein, 123 aa, Artificial Sequence
  Description of Artificial Sequence: Synthetic polypeptide
EVQLLESGPTLVKPTQTLTLTCTFSGFSFTTHKMGVDWIRQPPGKALEWLAGIHIYDDKRYSPSLQSRLTITKDTSKNQVVLTMTNMDPVDTATYYCAYRRYNWNYENWFDPWGQGTLVTVSS

SEQ ID NO: 16711 - DNA, 255 bp, Artificial Sequence; identical to SEQ ID NO: 7139
  Description of Artificial Sequence: Synthetic polynucleotide

SEQ ID NO: 16712 - protein, 123 aa, Artificial Sequence; identical to SEQ ID NO: 10004
  Description of Artificial Sequence: Synthetic polypeptide

SEQ ID NO: 16713 - DNA, 255 bp, Artificial Sequence; identical to SEQ ID NO: 7035
  Description of Artificial Sequence: Synthetic polynucleotide

SEQ ID NO: 16714 - protein, 119 aa, Artificial Sequence; identical to SEQ ID NO: 9904
  Description of Artificial Sequence: Synthetic polypeptide

SEQ ID NO: 16715 - DNA, 255 bp, Artificial Sequence; identical to SEQ ID NO: 16507
  Description of Artificial Sequence: Synthetic polynucleotide

SEQ ID NO: 16716 - protein, 127 aa, Artificial Sequence
  Description of Artificial Sequence: Synthetic polypeptide
EVQLLESGGGLVQPGGSLRLSCAASGFTFSNAWMSWVRQAPGKGLEWVGRITSGIYGGTTDYAAPVKGRFTISRDDSKNTLYLQMNSLKTEDTAVYYCTTPSYSGSYYNYFSVMDVWGQGTTVTVSS

SEQ ID NO: 16717 - DNA, 255 bp, Artificial Sequence; identical to SEQ ID NO: 16509
  Description of Artificial Sequence: Synthetic polynucleotide

SEQ ID NO: 16718 - protein, 127 aa, Artificial Sequence
  Description of Artificial Sequence: Synthetic polypeptide
EVQLLESGGGLVQPGGSLRLSCAASGFTFSNAWMSWVRQAPGKGLEWVGRIRSRPYGGTTDYAAPVKGRFTISRDDSKNTLYLQMNSLKTEDTAVYYCTTPSYSGSYYNYFSVMDVWGQGTTVTVSS

SEQ ID NO: 16719 - protein, 23 aa, Artificial Sequence
  Description of Artificial Sequence: Synthetic peptide
DIQMTQSPSSLSASVGDRVTITC

SEQ ID NO: 16720 - protein, 23 aa, Artificial Sequence
  Description of Artificial Sequence: Synthetic peptide
ELVMTQSPSSLSASVGDRVTITC

SEQ ID NO: 16721 - protein, 23 aa, Artificial Sequence
  Description of Artificial Sequence: Synthetic peptide
ELQMTQSPSSLSASVGDRVTITC

SEQ ID NO: 16722 - protein, 23 aa, Artificial Sequence
  Description of Artificial Sequence: Synthetic peptide
ELVMTQSPSSLSASVGDRVTITC

SEQ ID NO: 16723 - protein, 23 aa, Artificial Sequence
  Description of Artificial Sequence: Synthetic peptide
DIQMTQSPSSLSASVGDRVTITC

SEQ ID NO: 16724 - protein, 23 aa, Artificial Sequence
  Description of Artificial Sequence: Synthetic peptide
ELQMTQSPSSLSASVGDRVTITC

SEQ ID NO: 16725 - protein, 23 aa, Artificial Sequence
  Description of Artificial Sequence: Synthetic peptide
ELQMTQSPSSLSASVGDRVTITC

SEQ ID NO: 16726 - protein, 23 aa, Artificial Sequence
  Description of Artificial Sequence: Synthetic peptide
DIQMTQSPSSLSASVGDRVTITC

SEQ ID NO: 16727 - protein, 23 aa, Artificial Sequence
  Description of Artificial Sequence: Synthetic peptide
ELQMTQSPSSLSASVGDRVTITC

SEQ ID NO: 16728 - protein, 22 aa, Artificial Sequence
  Description of Artificial Sequence: Synthetic peptide
SYVLTQPPSVSVAPGKTARITC

SEQ ID NO: 16729 - protein, 22 aa, Artificial Sequence
  Description of Artificial Sequence: Synthetic peptide
ELVLTQPPSVSVAPGQTARITC

SEQ ID NO: 16730 - protein, 22 aa, Artificial Sequence
  Description of Artificial Sequence: Synthetic peptide
ELVLTQPPSVSVAPGQTARITC

SEQ ID NO: 16731 - protein, 22 aa, Artificial Sequence
  Description of Artificial Sequence: Synthetic peptide
ELVLTQPPSVSVAPGQTARITC

SEQ ID NO: 16732 - protein, 22 aa, Artificial Sequence
  Description of Artificial Sequence: Synthetic peptide
ELVLTQPPSVSVAPGQTARITC

SEQ ID NO: 16733 - protein, 22 aa, Artificial Sequence
  Description of Artificial Sequence: Synthetic peptide
ELVLTQPPSVSVAPGQTARITC

SEQ ID NO: 16734 - protein, 22 aa, Artificial Sequence
  Description of Artificial Sequence: Synthetic peptide
ELVLTQPPSVSVAPGQTARITC

SEQ ID NO: 16735 - protein, 22 aa, Artificial Sequence
  Description of Artificial Sequence: Synthetic peptide
SYVLTQPPSVSVAPGKTARITC

SEQ ID NO: 16736 - protein, 22 aa, Artificial Sequence
  Description of Artificial Sequence: Synthetic peptide
ELVLTQPPSVSVAPGQTARITC

SEQ ID NO: 16737 - protein, 30 aa, Artificial Sequence; identical to SEQ ID NO: 779
  Description of Artificial Sequence: Synthetic polypeptide

SEQ ID NO: 16738 - protein, 30 aa, Artificial Sequence; identical to SEQ ID NO: 779
  Description of Artificial Sequence: Synthetic polypeptide

SEQ ID NO: 16739 - protein, 30 aa, Artificial Sequence; identical to SEQ ID NO: 779
  Description of Artificial Sequence: Synthetic polypeptide

SEQ ID NO: 16740 - protein, 30 aa, Artificial Sequence; identical to SEQ ID NO: 779
  Description of Artificial Sequence: Synthetic polypeptide

SEQ ID NO: 16741 - protein, 30 aa, Artificial Sequence; identical to SEQ ID NO: 779
  Description of Artificial Sequence: Synthetic polypeptide

SEQ ID NO: 16742 - protein, 30 aa, Artificial Sequence; identical to SEQ ID NO: 779
  Description of Artificial Sequence: Synthetic polypeptide

SEQ ID NO: 16743 - protein, 30 aa, Artificial Sequence; identical to SEQ ID NO: 856
  Description of Artificial Sequence: Synthetic polypeptide

SEQ ID NO: 16744 - protein, 30 aa, Artificial Sequence; identical to SEQ ID NO: 787
  Description of Artificial Sequence: Synthetic polypeptide

SEQ ID NO: 16745 - protein, 30 aa, Artificial Sequence; identical to SEQ ID NO: 787
  Description of Artificial Sequence: Synthetic polypeptide

SEQ ID NO: 16746 - protein, 30 aa, Artificial Sequence; identical to SEQ ID NO: 832
  Description of Artificial Sequence: Synthetic polypeptide

SEQ ID NO: 16747 - protein, 30 aa, Artificial Sequence; identical to SEQ ID NO: 779
  Description of Artificial Sequence: Synthetic polypeptide

SEQ ID NO: 16748 - protein, 30 aa, Artificial Sequence; identical to SEQ ID NO: 779
  Description of Artificial Sequence: Synthetic polypeptide

SEQ ID NO: 16749 - protein, 30 aa, Artificial Sequence; identical to SEQ ID NO: 779
  Description of Artificial Sequence: Synthetic polypeptide

SEQ ID NO: 16750 - protein, 30 aa, Artificial Sequence; identical to SEQ ID NO: 830
  Description of Artificial Sequence: Synthetic polypeptide

SEQ ID NO: 16751 - protein, 30 aa, Artificial Sequence; identical to SEQ ID NO: 10399
  Description of Artificial Sequence: Synthetic polypeptide

SEQ ID NO: 16752 - protein, 30 aa, Artificial Sequence; identical to SEQ ID NO: 10399
  Description of Artificial Sequence: Synthetic polypeptide

SEQ ID NO: 16753 - protein, 30 aa, Artificial Sequence; identical to SEQ ID NO: 842
  Description of Artificial Sequence: Synthetic polypeptide

SEQ ID NO: 16754 - protein, 30 aa, Artificial Sequence; identical to SEQ ID NO: 10409
  Description of Artificial Sequence: Synthetic polypeptide

SEQ ID NO: 16755 - protein, 11 aa, Artificial Sequence
  Description of Artificial Sequence: Synthetic peptide
RASQSISSYLN

SEQ ID NO: 16756 - protein, 11 aa, Artificial Sequence
  Description of Artificial Sequence: Synthetic peptide
RTSQSISSYLN

SEQ ID NO: 16757 - protein, 11 aa, Artificial Sequence
  Description of Artificial Sequence: Synthetic peptide
QASQDISNYFN

SEQ ID NO: 16758 - protein, 11 aa, Artificial Sequence
  Description of Artificial Sequence: Synthetic peptide
RTSQSISSYLN

SEQ ID NO: 16759 - protein, 11 aa, Artificial Sequence
  Description of Artificial Sequence: Synthetic peptide
RASQSISSYLN

SEQ ID NO: 16760 - protein, 11 aa, Artificial Sequence
  Description of Artificial Sequence: Synthetic peptide
QASQDISNYLN

SEQ ID NO: 16761 - protein, 11 aa, Artificial Sequence
  Description of Artificial Sequence: Synthetic peptide
QASQDISNYLN

SEQ ID NO: 16762 - protein, 11 aa, Artificial Sequence
  Description of Artificial Sequence: Synthetic peptide
RASQSISSYLN

SEQ ID NO: 16763 - protein, 11 aa, Artificial Sequence
  Description of Artificial Sequence: Synthetic peptide
RTSQSISSYLN

SEQ ID NO: 16764 - protein, 11 aa, Artificial Sequence
  Description of Artificial Sequence: Synthetic peptide
GGNNIGSKSVH

SEQ ID NO: 16765 - protein, 11 aa, Artificial Sequence
  Description of Artificial Sequence: Synthetic peptide
GGNNIGSKSVH

SEQ ID NO: 16766 - protein, 11 aa, Artificial Sequence
  Description of Artificial Sequence: Synthetic peptide
GGNNIGSKSVH

SEQ ID NO: 16767 - protein, 11 aa, Artificial Sequence
  Description of Artificial Sequence: Synthetic peptide
GGNNIGSKSVH

SEQ ID NO: 16768 - protein, 11 aa, Artificial Sequence
  Description of Artificial Sequence: Synthetic peptide
GGNNIGSKSVH

SEQ ID NO: 16769 - protein, 11 aa, Artificial Sequence
  Description of Artificial Sequence: Synthetic peptide
GGNNIGSKSVH

SEQ ID NO: 16770 - protein, 11 aa, Artificial Sequence
  Description of Artificial Sequence: Synthetic peptide
GGNNIGSKSVH

SEQ ID NO: 16771 - protein, 11 aa, Artificial Sequence
  Description of Artificial Sequence: Synthetic peptide
GGNNIGSKSVH

SEQ ID NO: 16772 - protein, 11 aa, Artificial Sequence
  Description of Artificial Sequence: Synthetic peptide
GGNNIGSKSVH

SEQ ID NO: 16773 - protein, 5 aa, Artificial Sequence
  Description of Artificial Sequence: Synthetic peptide
SYAMS

SEQ ID NO: 16774 - protein, 5 aa, Artificial Sequence
  Description of Artificial Sequence: Synthetic peptide
SHAMS

SEQ ID NO: 16775 - protein, 5 aa, Artificial Sequence
  Description of Artificial Sequence: Synthetic peptide
SHAMS

SEQ ID NO: 16776 - protein, 5 aa, Artificial Sequence
  Description of Artificial Sequence: Synthetic peptide
SHAMS

SEQ ID NO: 16777 - protein, 5 aa, Artificial Sequence
  Description of Artificial Sequence: Synthetic peptide
SYAMS

SEQ ID NO: 16778 - protein, 5 aa, Artificial Sequence
  Description of Artificial Sequence: Synthetic peptide
SHAMS

SEQ ID NO: 16779 - protein, 5 aa, Artificial Sequence
  Description of Artificial Sequence: Synthetic peptide
DYYMS

SEQ ID NO: 16780 - protein, 5 aa, Artificial Sequence
  Description of Artificial Sequence: Synthetic peptide
DYYMS

SEQ ID NO: 16781 - protein, 5 aa, Artificial Sequence
  Description of Artificial Sequence: Synthetic peptide
DYYMS

SEQ ID NO: 16782 - protein, 5 aa, Artificial Sequence
  Description of Artificial Sequence: Synthetic peptide
NAWMS

SEQ ID NO: 16783 - protein, 5 aa, Artificial Sequence
  Description of Artificial Sequence: Synthetic peptide
NAWMS

SEQ ID NO: 16784 - protein, 5 aa, Artificial Sequence
  Description of Artificial Sequence: Synthetic peptide
NAWMS

SEQ ID NO: 16785 - protein, 5 aa, Artificial Sequence
  Description of Artificial Sequence: Synthetic peptide
NAWMS

SEQ ID NO: 16786 - protein, 7 aa, Artificial Sequence
  Description of Artificial Sequence: Synthetic peptide
TSGMRVS

SEQ ID NO: 16787 - protein, 7 aa, Artificial Sequence
  Description of Artificial Sequence: Synthetic peptide
THKMGVD

SEQ ID NO: 16788 - protein, 7 aa, Artificial Sequence
  Description of Artificial Sequence: Synthetic peptide
THKMGVD

SEQ ID NO: 16789 - protein, 7 aa, Artificial Sequence
  Description of Artificial Sequence: Synthetic peptide
TSGVGVG

SEQ ID NO: 16790 - protein, 7 aa, Artificial Sequence
  Description of Artificial Sequence: Synthetic peptide
THKMGVD

SEQ ID NO: 16791 - protein, 15 aa, Artificial Sequence
  Description of Artificial Sequence: Synthetic peptide
WYQQKPGKAPKLLIY

SEQ ID NO: 16792 - protein, 15 aa, Artificial Sequence
  Description of Artificial Sequence: Synthetic peptide
WYQQKPGRAPKLLIF

SEQ ID NO: 16793 - protein, 15 aa, Artificial Sequence
  Description of Artificial Sequence: Synthetic peptide
WYQQKPGKAPKLLIY

SEQ ID NO: 16794 - protein, 15 aa, Artificial Sequence
  Description of Artificial Sequence: Synthetic peptide
WYQQKPGRAPKLLIF

SEQ ID NO: 16795 - protein, 15 aa, Artificial Sequence
  Description of Artificial Sequence: Synthetic peptide
WYQQKPGKAPKLLIY

SEQ ID NO: 16796 - protein, 15 aa, Artificial Sequence
  Description of Artificial Sequence: Synthetic peptide
WYQQKPGKAPKLLIY

SEQ ID NO: 16797 - protein, 15 aa, Artificial Sequence
  Description of Artificial Sequence: Synthetic peptide
WYQQKPGKAPKLLIY

SEQ ID NO: 16798 - protein, 15 aa, Artificial Sequence
  Description of Artificial Sequence: Synthetic peptide
WYQQKPGKAPKLLIY

SEQ ID NO: 16799 - protein, 15 aa, Artificial Sequence
  Description of Artificial Sequence: Synthetic peptide
WYQQKPGRAPKLLIF

SEQ ID NO: 16800 - protein, 15 aa, Artificial Sequence
  Description of Artificial Sequence: Synthetic peptide
WYQQKPGQAPVLVIY

SEQ ID NO: 16801 - protein, 15 aa, Artificial Sequence
  Description of Artificial Sequence: Synthetic peptide
WYQQKPGQAPVMVVY

SEQ ID NO: 16802 - protein, 15 aa, Artificial Sequence
  Description of Artificial Sequence: Synthetic peptide
WYQQKPGQAPVLVVY

SEQ ID NO: 16803 - protein, 15 aa, Artificial Sequence
  Description of Artificial Sequence: Synthetic peptide
WYQQKPGQAPVMVVY

SEQ ID NO: 16804 - protein, 15 aa, Artificial Sequence
  Description of Artificial Sequence: Synthetic peptide
WYQQKPGQAPVLVVY

SEQ ID NO: 16805 - protein, 15 aa, Artificial Sequence
  Description of Artificial Sequence: Synthetic peptide
WYQQKPGQAPVMVVY

SEQ ID NO: 16806 - protein, 15 aa, Artificial Sequence
  Description of Artificial Sequence: Synthetic peptide
WYQQKPGQAPVMVVY

SEQ ID NO: 16807 - protein, 15 aa, Artificial Sequence
  Description of Artificial Sequence: Synthetic peptide
WYQQKPGQAPVLVIY

SEQ ID NO: 16808 - protein, 15 aa, Artificial Sequence
  Description of Artificial Sequence: Synthetic peptide
WYQQKPGQAPVMVVY

SEQ ID NO: 16809 - protein, 14 aa, Artificial Sequence
  Description of Artificial Sequence: Synthetic peptide
WVRQAPGKGLEWVS

SEQ ID NO: 16810 - protein, 14 aa, Artificial Sequence
  Description of Artificial Sequence: Synthetic peptide
WVRQAPGKGLEWVS

SEQ ID NO: 16811 - protein, 14 aa, Artificial Sequence
  Description of Artificial Sequence: Synthetic peptide
WVRQAPGKGLEWVS

SEQ ID NO: 16812 - protein, 14 aa, Artificial Sequence
  Description of Artificial Sequence: Synthetic peptide
WVRQAPGKGLEWVS

SEQ ID NO: 16813 - protein, 14 aa, Artificial Sequence
  Description of Artificial Sequence: Synthetic peptide
WVRQAPGKGLEWVS

SEQ ID NO: 16814 - protein, 14 aa, Artificial Sequence
  Description of Artificial Sequence: Synthetic peptide
WVRQAPGKGLEWVS

SEQ ID NO: 16815 - protein, 14 aa, Artificial Sequence
  Description of Artificial Sequence: Synthetic peptide
WIRQAPGKGLEWVS

SEQ ID NO: 16816 - protein, 14 aa, Artificial Sequence
  Description of Artificial Sequence: Synthetic peptide
WIRQAPGKGLEWVS

SEQ ID NO: 16817 - protein, 14 aa, Artificial Sequence
  Description of Artificial Sequence: Synthetic peptide
WIRQAPGKGLEWVS

SEQ ID NO: 16818 - protein, 14 aa, Artificial Sequence
  Description of Artificial Sequence: Synthetic peptide
WVRQAPGKGLEWVG

SEQ ID NO: 16819 - protein, 14 aa, Artificial Sequence
  Description of Artificial Sequence: Synthetic peptide
WVRQAPGKGLEWVG

SEQ ID NO: 16820 - protein, 14 aa, Artificial Sequence
  Description of Artificial Sequence: Synthetic peptide
WVRQAPGKGLEWVG

SEQ ID NO: 16821 - protein, 14 aa, Artificial Sequence
  Description of Artificial Sequence: Synthetic peptide
WVRQAPGKGLEWVG

SEQ ID NO: 16822 - protein, 14 aa, Artificial Sequence
  Description of Artificial Sequence: Synthetic peptide
WIRQPPGKALEWLA

SEQ ID NO: 16823 - protein, 14 aa, Artificial Sequence
  Description of Artificial Sequence: Synthetic peptide
WIRQPPGKALEWLA

SEQ ID NO: 16824 - protein, 14 aa, Artificial Sequence
  Description of Artificial Sequence: Synthetic peptide
WIRQPPGKALEWLA

SEQ ID NO: 16825 - protein, 14 aa, Artificial Sequence
  Description of Artificial Sequence: Synthetic peptide
WIRQPPGKALEWLA

SEQ ID NO: 16826 - protein, 14 aa, Artificial Sequence
  Description of Artificial Sequence: Synthetic peptide
WIRQPPGKALEWLA

SEQ ID NO: 16827 - protein, 7 aa, Artificial Sequence
  Description of Artificial Sequence: Synthetic peptide
AASSLQS

SEQ ID NO: 16828 - protein, 7 aa, Artificial Sequence
  Description of Artificial Sequence: Synthetic peptide
AASSLQG

SEQ ID NO: 16829 - protein, 7 aa, Artificial Sequence
  Description of Artificial Sequence: Synthetic peptide
AASSLQS

SEQ ID NO: 16830 - protein, 7 aa, Artificial Sequence
  Description of Artificial Sequence: Synthetic peptide
AASSLQS

SEQ ID NO: 16831 - protein, 7 aa, Artificial Sequence
  Description of Artificial Sequence: Synthetic peptide
AASSLQS

SEQ ID NO: 16832 - protein, 7 aa, Artificial Sequence
  Description of Artificial Sequence: Synthetic peptide
AASSLQS

SEQ ID NO: 16833 - protein, 7 aa, Artificial Sequence
  Description of Artificial Sequence: Synthetic peptide
AASSLQS

SEQ ID NO: 16834 - protein, 7 aa, Artificial Sequence
  Description of Artificial Sequence: Synthetic peptide
AASSLQS

SEQ ID NO: 16835 - protein, 7 aa, Artificial Sequence
  Description of Artificial Sequence: Synthetic peptide
AASSLQG

SEQ ID NO: 16836 - protein, 7 aa, Artificial Sequence
  Description of Artificial Sequence: Synthetic peptide
YDSDRPS

SEQ ID NO: 16837 - protein, 7 aa, Artificial Sequence
  Description of Artificial Sequence: Synthetic peptide
DDNDRPS

SEQ ID NO: 16838 - protein, 7 aa, Artificial Sequence
  Description of Artificial Sequence: Synthetic peptide
DDSDRPS

SEQ ID NO: 16839 - protein, 7 aa, Artificial Sequence
  Description of Artificial Sequence: Synthetic peptide
DDNDRPS

SEQ ID NO: 16840 - protein, 7 aa, Artificial Sequence
  Description of Artificial Sequence: Synthetic peptide
DDSDRPS

SEQ ID NO: 16841 - protein, 7 aa, Artificial Sequence
  Description of Artificial Sequence: Synthetic peptide
DDNDRPS

SEQ ID NO: 16842 - protein, 7 aa, Artificial Sequence
  Description of Artificial Sequence: Synthetic peptide
DDNDRPS

SEQ ID NO: 16843 - protein, 7 aa, Artificial Sequence
  Description of Artificial Sequence: Synthetic peptide
YDSDRPS

SEQ ID NO: 16844 - protein, 7 aa, Artificial Sequence
  Description of Artificial Sequence: Synthetic peptide
DDNDRPS

SEQ ID NO: 16845 - protein, 17 aa, Artificial Sequence
  Description of Artificial Sequence: Synthetic peptide
AISGSGGSTYYADSVKG

SEQ ID NO: 16846 - protein, 17 aa, Artificial Sequence
  Description of Artificial Sequence: Synthetic peptide
SISGSGGGTYYAASVKG

SEQ ID NO: 16847 - protein, 17 aa, Artificial Sequence
  Description of Artificial Sequence: Synthetic peptide
TISGSGGGTYYADSVKG

SEQ ID NO: 16848 - protein, 17 aa, Artificial Sequence
  Description of Artificial Sequence: Synthetic peptide
AISGSGGGTYNADSVKG

SEQ ID NO: 16849 - protein, 17 aa, Artificial Sequence
  Description of Artificial Sequence: Synthetic peptide
AISGSGGGTYYADSVKG

SEQ ID NO: 16850 - protein, 17 aa, Artificial Sequence
  Description of Artificial Sequence: Synthetic peptide
AISGSGGGTYNADSVKG

SEQ ID NO: 16851 - protein, 17 aa, Artificial Sequence
  Description of Artificial Sequence: Synthetic peptide
YISSSGSTIYYADSVKG

SEQ ID NO: 16852 - protein, 17 aa, Artificial Sequence
  Description of Artificial Sequence: Synthetic peptide
YISKSGSTIYYADSVKG

SEQ ID NO: 16853 - protein, 17 aa, Artificial Sequence
  Description of Artificial Sequence: Synthetic peptide
YISKSSYTVTYADSVKG

SEQ ID NO: 16854 - protein, 19 aa, Artificial Sequence
  Description of Artificial Sequence: Synthetic peptide
RIKSKTDGGTTDYAAPVKG

SEQ ID NO: 16855 - protein, 19 aa, Artificial Sequence
  Description of Artificial Sequence: Synthetic peptide
RIKSKTYGGTTDYAAPVKG

SEQ ID NO: 16856 - protein, 19 aa, Artificial Sequence
  Description of Artificial Sequence: Synthetic peptide
RITSGIYGGTTDYAAPVKG

SEQ ID NO: 16857 - protein, 19 aa, Artificial Sequence
  Description of Artificial Sequence: Synthetic peptide
RIRSRPYGGTTDYAAPVKG

SEQ ID NO: 16858 - protein, 16 aa, Artificial Sequence
  Description of Artificial Sequence: Synthetic peptide
RIDWDDDKFYSTSLKT

SEQ ID NO: 16859 - protein, 16 aa, Artificial Sequence
  Description of Artificial Sequence: Synthetic peptide
LIYWNDDKRYSPSLQS

SEQ ID NO: 16860 - protein, 16 aa, Artificial Sequence
  Description of Artificial Sequence: Synthetic peptide
LIYWNDDKRYSPSLQS

SEQ ID NO: 16861 - protein, 16 aa, Artificial Sequence
  Description of Artificial Sequence: Synthetic peptide
LIYWNDDKRYSPSLKS

SEQ ID NO: 16862 - protein, 16 aa, Artificial Sequence
  Description of Artificial Sequence: Synthetic peptide
GIHIYDDKRYSPSLQS

SEQ ID NO: 16863 - protein, 32 aa, Artificial Sequence; identical to SEQ ID NO: 1346
  Description of Artificial Sequence: Synthetic polypeptide

SEQ ID NO: 16864 - protein, 32 aa, Artificial Sequence; identical to SEQ ID NO: 1346
  Description of Artificial Sequence: Synthetic polypeptide

SEQ ID NO: 16865 - protein, 32 aa, Artificial Sequence; identical to SEQ ID NO: 1346
  Description of Artificial Sequence: Synthetic polypeptide

SEQ ID NO: 16866 - protein, 32 aa, Artificial Sequence; identical to SEQ ID NO: 1346
  Description of Artificial Sequence: Synthetic polypeptide

SEQ ID NO: 16867 - protein, 32 aa, Artificial Sequence; identical to SEQ ID NO: 1346
  Description of Artificial Sequence: Synthetic polypeptide

SEQ ID NO: 16868 - protein, 32 aa, Artificial Sequence; identical to SEQ ID NO: 1350
  Description of Artificial Sequence: Synthetic polypeptide

SEQ ID NO: 16869 - protein, 32 aa, Artificial Sequence; identical to SEQ ID NO: 1346
  Description of Artificial Sequence: Synthetic polypeptide

SEQ ID NO: 16870 - protein, 32 aa, Artificial Sequence; identical to SEQ ID NO: 1346
  Description of Artificial Sequence: Synthetic polypeptide

SEQ ID NO: 16871 - protein, 32 aa, Artificial Sequence; identical to SEQ ID NO: 1346
  Description of Artificial Sequence: Synthetic polypeptide

SEQ ID NO: 16872 - protein, 32 aa, Artificial Sequence; identical to SEQ ID NO: 1374
  Description of Artificial Sequence: Synthetic polypeptide

SEQ ID NO: 16873 - protein, 32 aa, Artificial Sequence; identical to SEQ ID NO: 1374
  Description of Artificial Sequence: Synthetic polypeptide

SEQ ID NO: 16874 - protein, 32 aa, Artificial Sequence; identical to SEQ ID NO: 1374
  Description of Artificial Sequence: Synthetic polypeptide

SEQ ID NO: 16875 - protein, 32 aa, Artificial Sequence; identical to SEQ ID NO: 1374
  Description of Artificial Sequence: Synthetic polypeptide

SEQ ID NO: 16876 - protein, 32 aa, Artificial Sequence; identical to SEQ ID NO: 1374
  Description of Artificial Sequence: Synthetic polypeptide

SEQ ID NO: 16877 - protein, 32 aa, Artificial Sequence; identical to SEQ ID NO: 1374
  Description of Artificial Sequence: Synthetic polypeptide

SEQ ID NO: 16878 - protein, 32 aa, Artificial Sequence; identical to SEQ ID NO: 1374
  Description of Artificial Sequence: Synthetic polypeptide

SEQ ID NO: 16879 - protein, 32 aa, Artificial Sequence; identical to SEQ ID NO: 1374
  Description of Artificial Sequence: Synthetic polypeptide

SEQ ID NO: 16880 - protein, 32 aa, Artificial Sequence; identical to SEQ ID NO: 1379
  Description of Artificial Sequence: Synthetic polypeptide

SEQ ID NO: 16881 - protein, 32 aa, Artificial Sequence; identical to SEQ ID NO: 1427
  Description of Artificial Sequence: Synthetic polypeptide

SEQ ID NO: 16882 - protein, 32 aa, Artificial Sequence; identical to SEQ ID NO: 1428
  Description of Artificial Sequence: Synthetic polypeptide

SEQ ID NO: 16883 - protein, 32 aa, Artificial Sequence; identical to SEQ ID NO: 1428
  Description of Artificial Sequence: Synthetic polypeptide

SEQ ID NO: 16884 - protein, 32 aa, Artificial Sequence; identical to SEQ ID NO: 1432
  Description of Artificial Sequence: Synthetic polypeptide

SEQ ID NO: 16885 - protein, 32 aa, Artificial Sequence; identical to SEQ ID NO: 1434
  Description of Artificial Sequence: Synthetic polypeptide

SEQ ID NO: 16886 - protein, 32 aa, Artificial Sequence; identical to SEQ ID NO: 1428
  Description of Artificial Sequence: Synthetic polypeptide

SEQ ID NO: 16887 - protein, 32 aa, Artificial Sequence; identical to SEQ ID NO: 1504
  Description of Artificial Sequence: Synthetic polypeptide

SEQ ID NO: 16888 - protein, 32 aa, Artificial Sequence; identical to SEQ ID NO: 1505
  Description of Artificial Sequence: Synthetic polypeptide

SEQ ID NO: 16889 - protein, 32 aa, Artificial Sequence; identical to SEQ ID NO: 1505
  Description of Artificial Sequence: Synthetic polypeptide

SEQ ID NO: 16890 - protein, 32 aa, Artificial Sequence; identical to SEQ ID NO: 1480
  Description of Artificial Sequence: Synthetic polypeptide

SEQ ID NO: 16891 - protein, 32 aa, Artificial Sequence; identical to SEQ ID NO: 1481
  Description of Artificial Sequence: Synthetic polypeptide

SEQ ID NO: 16892 - protein, 32 aa, Artificial Sequence; identical to SEQ ID NO: 1480
  Description of Artificial Sequence: Synthetic polypeptide

SEQ ID NO: 16893 - protein, 32 aa, Artificial Sequence; identical to SEQ ID NO: 1480
  Description of Artificial Sequence: Synthetic polypeptide

SEQ ID NO: 16894 - protein, 32 aa, Artificial Sequence; identical to SEQ ID NO: 1478
  Description of Artificial Sequence: Synthetic polypeptide

SEQ ID NO: 16895 - protein, 32 aa, Artificial Sequence; identical to SEQ ID NO: 1479
  Description of Artificial Sequence: Synthetic polypeptide

SEQ ID NO: 16896 - protein, 32 aa, Artificial Sequence; identical to SEQ ID NO: 1479
  Description of Artificial Sequence: Synthetic polypeptide

SEQ ID NO: 16897 - protein, 32 aa, Artificial Sequence; identical to SEQ ID NO: 1490
  Description of Artificial Sequence: Synthetic polypeptide

SEQ ID NO: 16898 - protein, 32 aa, Artificial Sequence; identical to SEQ ID NO: 1479
  Description of Artificial Sequence: Synthetic polypeptide

SEQ ID NO: 16899 - protein, 9 aa, Artificial Sequence
  Description of Artificial Sequence: Synthetic peptide
QQSYSTPFT

SEQ ID NO: 16900 - protein, 9 aa, Artificial Sequence
  Description of Artificial Sequence: Synthetic peptide
QQSYSSPFT

SEQ ID NO: 16901 - protein, 9 aa, Artificial Sequence
  Description of Artificial Sequence: Synthetic peptide
QQSYITPFT

SEQ ID NO: 16902 - protein, 9 aa, Artificial Sequence
  Description of Artificial Sequence: Synthetic peptide
QQTYSMPFT

SEQ ID NO: 16903 - protein, 9 aa, Artificial Sequence
  Description of Artificial Sequence: Synthetic peptide
QQSYSTPWT

SEQ ID NO: 16904 - protein, 9 aa, Artificial Sequence
  Description of Artificial Sequence: Synthetic peptide
QQSYYYPTL

SEQ ID NO: 16905 - protein, 9 aa, Artificial Sequence
  Description of Artificial Sequence: Synthetic peptide
QQSYFPVVE

SEQ ID NO: 16906 - protein, 9 aa, Artificial Sequence
  Description of Artificial Sequence: Synthetic peptide
QQSYSTPYT

SEQ ID NO: 16907 - protein, 9 aa, Artificial Sequence
  Description of Artificial Sequence: Synthetic peptide
QQTYSSPFT

SEQ ID NO: 16908 - protein, 11 aa, Artificial Sequence
  Description of Artificial Sequence: Synthetic peptide
QVWDSSSDHVV

SEQ ID NO: 16909 - protein, 11 aa, Artificial Sequence
  Description of Artificial Sequence: Synthetic peptide
QVWDYSPLRHV

SEQ ID NO: 16910 - protein, 12 aa, Artificial Sequence
  Description of Artificial Sequence: Synthetic peptide
QVWDSSLSYGTV

SEQ ID NO: 16911 - protein, 11 aa, Artificial Sequence
  Description of Artificial Sequence: Synthetic peptide
QVWDYYSNRAV

SEQ ID NO: 16912 - protein, 12 aa, Artificial Sequence
  Description of Artificial Sequence: Synthetic peptide
QVWDASAGYGVV

SEQ ID NO: 16913 - protein, 11 aa, Artificial Sequence
  Description of Artificial Sequence: Synthetic peptide
QVWDYSGQRQV

SEQ ID NO: 16914 - protein, 11 aa, Artificial Sequence
  Description of Artificial Sequence: Synthetic peptide
QVWDYVAPRHV

SEQ ID NO: 16915 - protein, 11 aa, Artificial Sequence
  Description of Artificial Sequence: Synthetic peptide
QVWDSSSDHWV

SEQ ID NO: 16916 - protein, 11 aa, Artificial Sequence
  Description of Artificial Sequence: Synthetic peptide
QVWDYRTLDWV

SEQ ID NO: 16917 - protein, 10 aa, Artificial Sequence
  Description of Artificial Sequence: Synthetic peptide
GIAVAGYFDY

SEQ ID NO: 16918 - protein, 10 aa, Artificial Sequence
  Description of Artificial Sequence: Synthetic peptide
GKGVHLGFDY

SEQ ID NO: 16919 - protein, 10 aa, Artificial Sequence
  Description of Artificial Sequence: Synthetic peptide
GKGVHLGFDY

SEQ ID NO: 16920 - protein, 10 aa, Artificial Sequence
  Description of Artificial Sequence: Synthetic peptide
GKGVHLGFDY

SEQ ID NO: 16921 - protein, 10 aa, Artificial Sequence
  Description of Artificial Sequence: Synthetic peptide
GKGVHLGFDY

SEQ ID NO: 16922 - protein, 10 aa, Artificial Sequence
  Description of Artificial Sequence: Synthetic peptide
GKGVHLGFDY

SEQ ID NO: 16923 - protein, 9 aa, Artificial Sequence
  Description of Artificial Sequence: Synthetic peptide
YNWNDYFDY

SEQ ID NO: 16924 - protein, 8 aa, Artificial Sequence
  Description of Artificial Sequence: Synthetic peptide
YNYGHFDY

SEQ ID NO: 16925 - protein, 8 aa, Artificial Sequence
  Description of Artificial Sequence: Synthetic peptide
YNYGHFDY

SEQ ID NO: 16926 - protein, 19 aa, Artificial Sequence
  Description of Artificial Sequence: Synthetic peptide
YYYGSGSYYNYYYYYGMDV

SEQ ID NO: 16927 - protein, 16 aa, Artificial Sequence
  Description of Artificial Sequence: Synthetic peptide
PSYSGSYYNYFSVMDV

SEQ ID NO: 16928 - protein, 16 aa, Artificial Sequence
  Description of Artificial Sequence: Synthetic peptide
PSYSGSYYNYFSVMDV

SEQ ID NO: 16929 - protein, 16 aa, Artificial Sequence
  Description of Artificial Sequence: Synthetic peptide
PSYSGSYYNYFSVMDV

SEQ ID NO: 16930 - protein, 8 aa, Artificial Sequence
  Description of Artificial Sequence: Synthetic peptide
LLLNWFDP

SEQ ID NO: 16931 - protein, 13 aa, Artificial Sequence
  Description of Artificial Sequence: Synthetic peptide
RRYNWNYENWFDP

SEQ ID NO: 16932 - protein, 13 aa, Artificial Sequence
  Description of Artificial Sequence: Synthetic peptide
RRYNWNYENWFDP

SEQ ID NO: 16933 - protein, 8 aa, Artificial Sequence
  Description of Artificial Sequence: Synthetic peptide
LLLNWFDP

SEQ ID NO: 16934 - protein, 13 aa, Artificial Sequence
  Description of Artificial Sequence: Synthetic peptide
RRYNWNYENWFDP

SEQ ID NO: 16935 - protein, 10 aa, Artificial Sequence
  Description of Artificial Sequence: Synthetic peptide
FGPGTKVDIK

SEQ ID NO: 16936 - protein, 10 aa, Artificial Sequence
  Description of Artificial Sequence: Synthetic peptide
FGPGTKVEIK

SEQ ID NO: 16937 - protein, 10 aa, Artificial Sequence
  Description of Artificial Sequence: Synthetic peptide
FGPGTKVEIK

SEQ ID NO: 16938 - protein, 10 aa, Artificial Sequence
  Description of Artificial Sequence: Synthetic peptide
FGPGTKVDIK

SEQ ID NO: 16939 - protein, 10 aa, Artificial Sequence
  Description of Artificial Sequence: Synthetic peptide
FGQGTKVEIK

SEQ ID NO: 16940 - protein, 10 aa, Artificial Sequence
  Description of Artificial Sequence: Synthetic peptide
FGPGTKVEIK

SEQ ID NO: 16941 - protein, 10 aa, Artificial Sequence
  Description of Artificial Sequence: Synthetic peptide
FGPGTKVEIK

SEQ ID NO: 16942 - protein, 10 aa, Artificial Sequence
  Description of Artificial Sequence: Synthetic peptide
FGQGTKLEIK

SEQ ID NO: 16943 - protein, 10 aa, Artificial Sequence
  Description of Artificial Sequence: Synthetic peptide
FGPGTKLEIK

SEQ ID NO: 16944 - protein, 10 aa, Artificial Sequence
  Description of Artificial Sequence: Synthetic peptide
FGGGTKLTVL

SEQ ID NO: 16945 - protein, 10 aa, Artificial Sequence
  Description of Artificial Sequence: Synthetic peptide
FGGGTKLTVL

SEQ ID NO: 16946 - protein, 10 aa, Artificial Sequence
  Description of Artificial Sequence: Synthetic peptide
FGGGTKLTVL

SEQ ID NO: 16947 - protein, 10 aa, Artificial Sequence
  Description of Artificial Sequence: Synthetic peptide
FGGGTKLTVL

SEQ ID NO: 16948 - protein, 10 aa, Artificial Sequence
  Description of Artificial Sequence: Synthetic peptide
FGGGTKLTVL

SEQ ID NO: 16949 - protein, 10 aa, Artificial Sequence
  Description of Artificial Sequence: Synthetic peptide
FGGGTKLTVL

SEQ ID NO: 16950 - protein, 10 aa, Artificial Sequence
  Description of Artificial Sequence: Synthetic peptide
FGGGTKLTVL

SEQ ID NO: 16951 - protein, 10 aa, Artificial Sequence
  Description of Artificial Sequence: Synthetic peptide
FGGGTKLTVL

SEQ ID NO: 16952 - protein, 10 aa, Artificial Sequence
  Description of Artificial Sequence: Synthetic peptide
FGGGTKLTVL

SEQ ID NO: 16953 - protein, 11 aa, Artificial Sequence
  Description of Artificial Sequence: Synthetic peptide
WGQGTLVTVSS

SEQ ID NO: 16954 - protein, 11 aa, Artificial Sequence
  Description of Artificial Sequence: Synthetic peptide
WGQGTLVTVSS

SEQ ID NO: 16955 - protein, 11 aa, Artificial Sequence
  Description of Artificial Sequence: Synthetic peptide
WGQGTLVTVSS

SEQ ID NO: 16956 - protein, 11 aa, Artificial Sequence
  Description of Artificial Sequence: Synthetic peptide
WGQGTLVTVSS

SEQ ID NO: 16957 - protein, 11 aa, Artificial Sequence
  Description of Artificial Sequence: Synthetic peptide
WGQGTLVTVSS

SEQ ID NO: 16958 - protein, 11 aa, Artificial Sequence
  Description of Artificial Sequence: Synthetic peptide
WGQGTLVTVSS

SEQ ID NO: 16959 - protein, 11 aa, Artificial Sequence
  Description of Artificial Sequence: Synthetic peptide
WGQGTLVTVSS

SEQ ID NO: 16960 - protein, 11 aa, Artificial Sequence
  Description of Artificial Sequence: Synthetic peptide
WGQGTLVTVSS

SEQ ID NO: 16961 - protein, 11 aa, Artificial Sequence
  Description of Artificial Sequence: Synthetic peptide
WGQGTLVTVSS

SEQ ID NO: 16962 - protein, 11 aa, Artificial Sequence
  Description of Artificial Sequence: Synthetic peptide
WGQGTTVTVSS

SEQ ID NO: 16963 - protein, 11 aa, Artificial Sequence
  Description of Artificial Sequence: Synthetic peptide
WGQGTTVTVSS

SEQ ID NO: 16964 - protein, 11 aa, Artificial Sequence
  Description of Artificial Sequence: Synthetic peptide
WGQGTTVTVSS

SEQ ID NO: 16965 - protein, 11 aa, Artificial Sequence
  Description of Artificial Sequence: Synthetic peptide
WGQGTTVTVSS

SEQ ID NO: 16966 - protein, 11 aa, Artificial Sequence
  Description of Artificial Sequence: Synthetic peptide
WGQGTLVTVSS

SEQ ID NO: 16967 - protein, 11 aa, Artificial Sequence
  Description of Artificial Sequence: Synthetic peptide
WGQGTLVTVSS

SEQ ID NO: 16968 - protein, 11 aa, Artificial Sequence
  Description of Artificial Sequence: Synthetic peptide
WGQGTLVTVSS

SEQ ID NO: 16969 - protein, 11 aa, Artificial Sequence
  Description of Artificial Sequence: Synthetic peptide
WGQGTLVTVSS

SEQ ID NO: 16970 - protein, 11 aa, Artificial Sequence
  Description of Artificial Sequence: Synthetic peptide
WGQGTLVTVSS

SEQ ID NO: 16971 - protein, 23 aa, Artificial Sequence
  Description of Artificial Sequence: Synthetic peptide
DIQMTQSPSSLSASVGDRVTITC

SEQ ID NO: 16972 - protein, 23 aa, Artificial Sequence
  Description of Artificial Sequence: Synthetic peptide
ELVMTQSPSSLSASVGDRVTITC

SEQ ID NO: 16973 - protein, 23 aa, Artificial Sequence
  Description of Artificial Sequence: Synthetic peptide
ELQMTQSPSSLSASVGDRVTITC

SEQ ID NO: 16974 - protein, 23 aa, Artificial Sequence
  Description of Artificial Sequence: Synthetic peptide
ELVMTQSPSSLSASVGDRVTITC

SEQ ID NO: 16975 - protein, 23 aa, Artificial Sequence
  Description of Artificial Sequence: Synthetic peptide
DIQMTQSPSSLSASVGDRVTITC

SEQ ID NO: 16976 - protein, 23 aa, Artificial Sequence
  Description of Artificial Sequence: Synthetic peptide
ELQMTQSPSSLSASVGDRVTITC

SEQ ID NO: 16977 - protein, 23 aa, Artificial Sequence
  Description of Artificial Sequence: Synthetic peptide
ELQMTQSPSSLSASVGDRVTITC

SEQ ID NO: 16978 - protein, 23 aa, Artificial Sequence
  Description of Artificial Sequence: Synthetic peptide
DIQMTQSPSSLSASVGDRVTITC

SEQ ID NO: 16979 - protein, 23 aa, Artificial Sequence
  Description of Artificial Sequence: Synthetic peptide
ELQMTQSPSSLSASVGDRVTITC

SEQ ID NO: 16980 - protein, 22 aa, Artificial Sequence
  Description of Artificial Sequence: Synthetic peptide
SYVLTQPPSVSVAPGKTARITC

SEQ ID NO: 16981 - protein, 22 aa, Artificial Sequence
  Description of Artificial Sequence: Synthetic peptide
ELVLTQPPSVSVAPGQTARITC

SEQ ID NO: 16982 - protein, 22 aa, Artificial Sequence
  Description of Artificial Sequence: Synthetic peptide
ELVLTQPPSVSVAPGQTARITC

SEQ ID NO: 16983 - protein, 22 aa, Artificial Sequence
  Description of Artificial Sequence: Synthetic peptide
ELVLTQPPSVSVAPGQTARITC

SEQ ID NO: 16984 - protein, 22 aa, Artificial Sequence
  Description of Artificial Sequence: Synthetic peptide
ELVLTQPPSVSVAPGQTARITC

SEQ ID NO: 16985 - protein, 22 aa, Artificial Sequence
  Description of Artificial Sequence: Synthetic peptide
ELVLTQPPSVSVAPGQTARITC

SEQ ID NO: 16986 - protein, 22 aa, Artificial Sequence
  Description of Artificial Sequence: Synthetic peptide
ELVLTQPPSVSVAPGQTARITC

SEQ ID NO: 16987 - protein, 22 aa, Artificial Sequence
  Description of Artificial Sequence: Synthetic peptide
SYVLTQPPSVSVAPGKTARITC

SEQ ID NO: 16988 - protein, 22 aa, Artificial Sequence
  Description of Artificial Sequence: Synthetic peptide
ELVLTQPPSVSVAPGQTARITC

SEQ ID NO: 16989 - protein, 30 aa, Artificial Sequence; identical to SEQ ID NO: 779
  Description of Artificial Sequence: Synthetic polypeptide

SEQ ID NO: 16990 - protein, 30 aa, Artificial Sequence; identical to SEQ ID NO: 779
  Description of Artificial Sequence: Synthetic polypeptide

SEQ ID NO: 16991 - protein, 30 aa, Artificial Sequence; identical to SEQ ID NO: 779
  Description of Artificial Sequence: Synthetic polypeptide

SEQ ID NO: 16992 - protein, 30 aa, Artificial Sequence; identical to SEQ ID NO: 779
  Description of Artificial Sequence: Synthetic polypeptide

SEQ ID NO: 16993 - protein, 30 aa, Artificial Sequence; identical to SEQ ID NO: 779
  Description of Artificial Sequence: Synthetic polypeptide

SEQ ID NO: 16994 - protein, 30 aa, Artificial Sequence; identical to SEQ ID NO: 779
  Description of Artificial Sequence: Synthetic polypeptide

SEQ ID NO: 16995 - protein, 30 aa, Artificial Sequence; identical to SEQ ID NO: 856
  Description of Artificial Sequence: Synthetic polypeptide

SEQ ID NO: 16996 - protein, 30 aa, Artificial Sequence; identical to SEQ ID NO: 787
  Description of Artificial Sequence: Synthetic polypeptide

SEQ ID NO: 16997 - protein, 30 aa, Artificial Sequence; identical to SEQ ID NO: 787
  Description of Artificial Sequence: Synthetic polypeptide

SEQ ID NO: 16998 - protein, 30 aa, Artificial Sequence; identical to SEQ ID NO: 832
  Description of Artificial Sequence: Synthetic polypeptide

SEQ ID NO: 16999 - protein, 30 aa, Artificial Sequence; identical to SEQ ID NO: 779
  Description of Artificial Sequence: Synthetic polypeptide

SEQ ID NO: 17000 - protein, 30 aa, Artificial Sequence; identical to SEQ ID NO: 779
  Description of Artificial Sequence: Synthetic polypeptide

SEQ ID NO: 17001 - protein, 30 aa, Artificial Sequence; identical to SEQ ID NO: 779
  Description of Artificial Sequence: Synthetic polypeptide

SEQ ID NO: 17002 - protein, 30 aa, Artificial Sequence; identical to SEQ ID NO: 830
  Description of Artificial Sequence: Synthetic polypeptide

SEQ ID NO: 17003 - protein, 30 aa, Artificial Sequence; identical to SEQ ID NO: 10399
  Description of Artificial Sequence: Synthetic polypeptide

SEQ ID NO: 17004 - protein, 30 aa, Artificial Sequence; identical to SEQ ID NO: 10399
  Description of Artificial Sequence: Synthetic polypeptide

SEQ ID NO: 17005 - protein, 30 aa, Artificial Sequence; identical to SEQ ID NO: 842
  Description of Artificial Sequence: Synthetic polypeptide

SEQ ID NO: 17006 - protein, 30 aa, Artificial Sequence; identical to SEQ ID NO: 10409
  Description of Artificial Sequence: Synthetic polypeptide

SEQ ID NO: 17007 - protein, 11 aa, Artificial Sequence
  Description of Artificial Sequence: Synthetic peptide
RASQSISSYLN

SEQ ID NO: 17008 - protein, 11 aa, Artificial Sequence
  Description of Artificial Sequence: Synthetic peptide
RTSQSISSYLN

SEQ ID NO: 17009 - protein, 11 aa, Artificial Sequence
  Description of Artificial Sequence: Synthetic peptide
QASQDISNYFN

SEQ ID NO: 17010 - protein, 11 aa, Artificial Sequence
  Description of Artificial Sequence: Synthetic peptide
RTSQSISSYLN

SEQ ID NO: 17011 - protein, 11 aa, Artificial Sequence
  Description of Artificial Sequence: Synthetic peptide
RASQSISSYLN

SEQ ID NO: 17012 - protein, 11 aa, Artificial Sequence
  Description of Artificial Sequence: Synthetic peptide
QASQDISNYLN

SEQ ID NO: 17013 - protein, 11 aa, Artificial Sequence
  Description of Artificial Sequence: Synthetic peptide
QASQDISNYLN

SEQ ID NO: 17014 - protein, 11 aa, Artificial Sequence
  Description of Artificial Sequence: Synthetic peptide
RASQSISSYLN

SEQ ID NO: 17015 - protein, 11 aa, Artificial Sequence
  Description of Artificial Sequence: Synthetic peptide
RTSQSISSYLN

SEQ ID NO: 17016 - protein, 11 aa, Artificial Sequence
  Description of Artificial Sequence: Synthetic peptide
GGNNIGSKSVH

SEQ ID NO: 17017 - protein, 11 aa, Artificial Sequence
  Description of Artificial Sequence: Synthetic peptide
GGNNIGSKSVH

SEQ ID NO: 17018 - protein, 11 aa, Artificial Sequence
  Description of Artificial Sequence: Synthetic peptide
GGNNIGSKSVH

SEQ ID NO: 17019 - protein, 11 aa, Artificial Sequence
  Description of Artificial Sequence: Synthetic peptide
GGNNIGSKSVH

SEQ ID NO: 17020 - protein, 11 aa, Artificial Sequence
  Description of Artificial Sequence: Synthetic peptide
GGNNIGSKSVH

SEQ ID NO: 17021 - protein, 11 aa, Artificial Sequence
  Description of Artificial Sequence: Synthetic peptide
GGNNIGSKSVH

SEQ ID NO: 17022 - protein, 11 aa, Artificial Sequence
  Description of Artificial Sequence: Synthetic peptide
GGNNIGSKSVH

SEQ ID NO: 17023 - protein, 11 aa, Artificial Sequence
  Description of Artificial Sequence: Synthetic peptide
GGNNIGSKSVH

SEQ ID NO: 17024 - protein, 11 aa, Artificial Sequence
  Description of Artificial Sequence: Synthetic peptide
GGNNIGSKSVH

SEQ ID NO: 17025 - protein, 5 aa, Artificial Sequence
  Description of Artificial Sequence: Synthetic peptide
SYAMS

SEQ ID NO: 17026 - protein, 5 aa, Artificial Sequence
  Description of Artificial Sequence: Synthetic peptide
SHAMS

SEQ ID NO: 17027 - protein, 5 aa, Artificial Sequence
  Description of Artificial Sequence: Synthetic peptide
SHAMS

SEQ ID NO: 17028 - protein, 5 aa, Artificial Sequence
  Description of Artificial Sequence: Synthetic peptide
SHAMS

SEQ ID NO: 17029 - protein, 5 aa, Artificial Sequence
  Description of Artificial Sequence: Synthetic peptide
SYAMS

SEQ ID NO: 17030 - protein, 5 aa, Artificial Sequence
  Description of Artificial Sequence: Synthetic peptide
SHAMS

SEQ ID NO: 17031 - protein, 5 aa, Artificial Sequence
  Description of Artificial Sequence: Synthetic peptide
DYYMS

SEQ ID NO: 17032 - protein, 5 aa, Artificial Sequence
  Description of Artificial Sequence: Synthetic peptide
DYYMS

SEQ ID NO: 17033 - protein, 5 aa, Artificial Sequence
  Description of Artificial Sequence: Synthetic peptide
DYYMS

SEQ ID NO: 17034 - protein, 5 aa, Artificial Sequence
  Description of Artificial Sequence: Synthetic peptide
NAWMS

SEQ ID NO: 17035 - protein, 5 aa, Artificial Sequence
  Description of Artificial Sequence: Synthetic peptide
NAWMS

SEQ ID NO: 17036 - protein, 5 aa, Artificial Sequence
  Description of Artificial Sequence: Synthetic peptide
NAWMS

SEQ ID NO: 17037 - protein, 5 aa, Artificial Sequence
  Description of Artificial Sequence: Synthetic peptide
NAWMS

SEQ ID NO: 17038 - protein, 7 aa, Artificial Sequence
  Description of Artificial Sequence: Synthetic peptide
TSGMRVS

SEQ ID NO: 17039 - protein, 7 aa, Artificial Sequence
  Description of Artificial Sequence: Synthetic peptide
THKMGVD

SEQ ID NO: 17040 - protein, 7 aa, Artificial Sequence
  Description of Artificial Sequence: Synthetic peptide
THKMGVD

SEQ ID NO: 17041 - protein, 7 aa, Artificial Sequence
  Description of Artificial Sequence: Synthetic peptide
TSGVGVG

SEQ ID NO: 17042 - protein, 7 aa, Artificial Sequence
  Description of Artificial Sequence: Synthetic peptide
THKMGVD

SEQ ID NO: 17043 - protein, 15 aa, Artificial Sequence
  Description of Artificial Sequence: Synthetic peptide
WYQQKPGKAPKLLIY

SEQ ID NO: 17044 - protein, 15 aa, Artificial Sequence
  Description of Artificial Sequence: Synthetic peptide
WYQQKPGRAPKLLIF

SEQ ID NO: 17045 - protein, 15 aa, Artificial Sequence
  Description of Artificial Sequence: Synthetic peptide
WYQQKPGKAPKLLIY

SEQ ID NO: 17046 - protein, 15 aa, Artificial Sequence
  Description of Artificial Sequence: Synthetic peptide
WYQQKPGRAPKLLIF

SEQ ID NO: 17047 - protein, 15 aa, Artificial Sequence
  Description of Artificial Sequence: Synthetic peptide
WYQQKPGKAPKLLIY

SEQ ID NO: 17048 - protein, 15 aa, Artificial Sequence
  Description of Artificial Sequence: Synthetic peptide
WYQQKPGKAPKLLIY

SEQ ID NO: 17049 - protein, 15 aa, Artificial Sequence
  Description of Artificial Sequence: Synthetic peptide
WYQQKPGKAPKLLIY

SEQ ID NO: 17050 - protein, 15 aa, Artificial Sequence
  Description of Artificial Sequence: Synthetic peptide
WYQQKPGKAPKLLIY

SEQ ID NO: 17051 - protein, 15 aa, Artificial Sequence
  Description of Artificial Sequence: Synthetic peptide
WYQQKPGRAPKLLIF

SEQ ID NO: 17052 - protein, 15 aa, Artificial Sequence
  Description of Artificial Sequence: Synthetic peptide
WYQQKPGQAPVLVIY

SEQ ID NO: 17053 - protein, 15 aa, Artificial Sequence
  Description of Artificial Sequence: Synthetic peptide
WYQQKPGQAPVMVVY

SEQ ID NO: 17054 - protein, 15 aa, Artificial Sequence
  Description of Artificial Sequence: Synthetic peptide
WYQQKPGQAPVLVVY

SEQ ID NO: 17055 - protein, 15 aa, Artificial Sequence
  Description of Artificial Sequence: Synthetic peptide
WYQQKPGQAPVMVVY

SEQ ID NO: 17056 - protein, 15 aa, Artificial Sequence
  Description of Artificial Sequence: Synthetic peptide
WYQQKPGQAPVLVVY

SEQ ID NO: 17057 - protein, 15 aa, Artificial Sequence
  Description of Artificial Sequence: Synthetic peptide
WYQQKPGQAPVMVVY

SEQ ID NO: 17058 - protein, 15 aa, Artificial Sequence
  Description of Artificial Sequence: Synthetic peptide
WYQQKPGQAPVMVVY

SEQ ID NO: 17059 - protein, 15 aa, Artificial Sequence
  Description of Artificial Sequence: Synthetic peptide
WYQQKPGQAPVLVIY

SEQ ID NO: 17060 - protein, 15 aa, Artificial Sequence
  Description of Artificial Sequence: Synthetic peptide
WYQQKPGQAPVMVVY

SEQ ID NO: 17061 - protein, 14 aa, Artificial Sequence
  Description of Artificial Sequence: Synthetic peptide
WVRQAPGKGLEWVS

SEQ ID NO: 17062 - protein, 14 aa, Artificial Sequence
  Description of Artificial Sequence: Synthetic peptide
WVRQAPGKGLEWVS

SEQ ID NO: 17063 - protein, 14 aa, Artificial Sequence
  Description of Artificial Sequence: Synthetic peptide
WVRQAPGKGLEWVS

SEQ ID NO: 17064 - protein, 14 aa, Artificial Sequence
  Description of Artificial Sequence: Synthetic peptide
WVRQAPGKGLEWVS

SEQ ID NO: 17065 - protein, 14 aa, Artificial Sequence
  Description of Artificial Sequence: Synthetic peptide
WVRQAPGKGLEWVS

SEQ ID NO: 17066 - protein, 14 aa, Artificial Sequence
  Description of Artificial Sequence: Synthetic peptide
WVRQAPGKGLEWVS

SEQ ID NO: 17067 - protein, 14 aa, Artificial Sequence
  Description of Artificial Sequence: Synthetic peptide
WIRQAPGKGLEWVS

SEQ ID NO: 17068 - protein, 14 aa, Artificial Sequence
  Description of Artificial Sequence: Synthetic peptide
WIRQAPGKGLEWVS

SEQ ID NO: 17069 - protein, 14 aa, Artificial Sequence
  Description of Artificial Sequence: Synthetic peptide
WIRQAPGKGLEWVS

SEQ ID NO: 17070 - protein, 14 aa, Artificial Sequence
  Description of Artificial Sequence: Synthetic peptide
WVRQAPGKGLEWVG

SEQ ID NO: 17071 - protein, 14 aa, Artificial Sequence
  Description of Artificial Sequence: Synthetic peptide
WVRQAPGKGLEWVG

SEQ ID NO: 17072 - protein, 14 aa, Artificial Sequence
  Description of Artificial Sequence: Synthetic peptide
WVRQAPGKGLEWVG

SEQ ID NO: 17073 - protein, 14 aa, Artificial Sequence
  Description of Artificial Sequence: Synthetic peptide
WVRQAPGKGLEWVG

SEQ ID NO: 17074 - protein, 14 aa, Artificial Sequence
  Description of Artificial Sequence: Synthetic peptide
WIRQPPGKALEWLA

SEQ ID NO: 17075 - protein, 14 aa, Artificial Sequence
  Description of Artificial Sequence: Synthetic peptide
WIRQPPGKALEWLA

SEQ ID NO: 17076 - protein, 14 aa, Artificial Sequence
  Description of Artificial Sequence: Synthetic peptide
WIRQPPGKALEWLA

SEQ ID NO: 17077 - protein, 14 aa, Artificial Sequence
  Description of Artificial Sequence: Synthetic peptide
WIRQPPGKALEWLA

SEQ ID NO: 17078 - protein, 14 aa, Artificial Sequence
  Description of Artificial Sequence: Synthetic peptide
WIRQPPGKALEWLA

SEQ ID NO: 17079 - protein, 7 aa, Artificial Sequence
  Description of Artificial Sequence: Synthetic peptide
AASSLQS

SEQ ID NO: 17080 - protein, 7 aa, Artificial Sequence
  Description of Artificial Sequence: Synthetic peptide
AASSLQG

SEQ ID NO: 17081 - protein, 7 aa, Artificial Sequence
  Description of Artificial Sequence: Synthetic peptide
AASSLQS

SEQ ID NO: 17082 - protein, 7 aa, Artificial Sequence
  Description of Artificial Sequence: Synthetic peptide
AASSLQS

SEQ ID NO: 17083 - protein, 7 aa, Artificial Sequence
  Description of Artificial Sequence: Synthetic peptide
AASSLQS

SEQ ID NO: 17084 - protein, 7 aa, Artificial Sequence
  Description of Artificial Sequence: Synthetic peptide
AASSLQS

SEQ ID NO: 17085 - protein, 7 aa, Artificial Sequence
  Description of Artificial Sequence: Synthetic peptide
AASSLQS

SEQ ID NO: 17086 - protein, 7 aa, Artificial Sequence
  Description of Artificial Sequence: Synthetic peptide
AASSLQS

SEQ ID NO: 17087 - protein, 7 aa, Artificial Sequence
  Description of Artificial Sequence: Synthetic peptide
AASSLQG

SEQ ID NO: 17088 - protein, 7 aa, Artificial Sequence
  Description of Artificial Sequence: Synthetic peptide
YDSDRPS

SEQ ID NO: 17089 - protein, 7 aa, Artificial Sequence
  Description of Artificial Sequence: Synthetic peptide
DDNDRPS

SEQ ID NO: 17090 - protein, 7 aa, Artificial Sequence
  Description of Artificial Sequence: Synthetic peptide
DDSDRPS

SEQ ID NO: 17091 - protein, 7 aa, Artificial Sequence
  Description of Artificial Sequence: Synthetic peptide
DDNDRPS

SEQ ID NO: 17092 - protein, 7 aa, Artificial Sequence
  Description of Artificial Sequence: Synthetic peptide
DDSDRPS

SEQ ID NO: 17093 - protein, 7 aa, Artificial Sequence
  Description of Artificial Sequence: Synthetic peptide
DDNDRPS

SEQ ID NO: 17094 - protein, 7 aa, Artificial Sequence
  Description of Artificial Sequence: Synthetic peptide
DDNDRPS

SEQ ID NO: 17095 - protein, 7 aa, Artificial Sequence
  Description of Artificial Sequence: Synthetic peptide
YDSDRPS

SEQ ID NO: 17096 - protein, 7 aa, Artificial Sequence
  Description of Artificial Sequence: Synthetic peptide
DDNDRPS

SEQ ID NO: 17097 - protein, 17 aa, Artificial Sequence
  Description of Artificial Sequence: Synthetic peptide
AISGSGGSTYYADSVKG

SEQ ID NO: 17098 - protein, 17 aa, Artificial Sequence
  Description of Artificial Sequence: Synthetic peptide
SISGSGGGTYYAASVKG

SEQ ID NO: 17099 - protein, 17 aa, Artificial Sequence
  Description of Artificial Sequence: Synthetic peptide
TISGSGGGTYYADSVKG

SEQ ID NO: 17100 - protein, 17 aa, Artificial Sequence
  Description of Artificial Sequence: Synthetic peptide
AISGSGGGTYNADSVKG

SEQ ID NO: 17101 - protein, 17 aa, Artificial Sequence
  Description of Artificial Sequence: Synthetic peptide
AISGSGGGTYYADSVKG

SEQ ID NO: 17102 - protein, 17 aa, Artificial Sequence
  Description of Artificial Sequence: Synthetic peptide
AISGSGGGTYNADSVKG

SEQ ID NO: 17103 - protein, 17 aa, Artificial Sequence
  Description of Artificial Sequence: Synthetic peptide
YISSSGSTIYYADSVKG

SEQ ID NO: 17104 - protein, 17 aa, Artificial Sequence
  Description of Artificial Sequence: Synthetic peptide
YISKSGSTIYYADSVKG

SEQ ID NO: 17105 - protein, 17 aa, Artificial Sequence
  Description of Artificial Sequence: Synthetic peptide
YISKSSYTVTYADSVKG

SEQ ID NO: 17106 - protein, 19 aa, Artificial Sequence
  Description of Artificial Sequence: Synthetic peptide
RIKSKTDGGTTDYAAPVKG

SEQ ID NO: 17107 - protein, 19 aa, Artificial Sequence
  Description of Artificial Sequence: Synthetic peptide
RIKSKTYGGTTDYAAPVKG

SEQ ID NO: 17108 - protein, 19 aa, Artificial Sequence
  Description of Artificial Sequence: Synthetic peptide
RITSGIYGGTTDYAAPVKG

SEQ ID NO: 17109 - protein, 19 aa, Artificial Sequence
  Description of Artificial Sequence: Synthetic peptide
RIRSRPYGGTTDYAAPVKG

SEQ ID NO: 17110 - protein, 16 aa, Artificial Sequence
  Description of Artificial Sequence: Synthetic peptide
RIDWDDDKFYSTSLKT

SEQ ID NO: 17111 - protein, 16 aa, Artificial Sequence
  Description of Artificial Sequence: Synthetic peptide
LIYWNDDKRYSPSLQS

SEQ ID NO: 17112 - protein, 16 aa, Artificial Sequence
  Description of Artificial Sequence: Synthetic peptide
LIYWNDDKRYSPSLQS

SEQ ID NO: 17113 - protein, 16 aa, Artificial Sequence
  Description of Artificial Sequence: Synthetic peptide
LIYWNDDKRYSPSLKS

SEQ ID NO: 17114 - protein, 16 aa, Artificial Sequence
  Description of Artificial Sequence: Synthetic peptide
GIHIYDDKRYSPSLQS

SEQ ID NO: 17115 - protein, 32 aa, Artificial Sequence; identical to SEQ ID NO: 1346
  Description of Artificial Sequence: Synthetic polypeptide

SEQ ID NO: 17116 - protein, 32 aa, Artificial Sequence; identical to SEQ ID NO: 1346
  Description of Artificial Sequence: Synthetic polypeptide

SEQ ID NO: 17117 - protein, 32 aa, Artificial Sequence; identical to SEQ ID NO: 1346
  Description of Artificial Sequence: Synthetic polypeptide

SEQ ID NO: 17118 - protein, 32 aa, Artificial Sequence; identical to SEQ ID NO: 1346
  Description of Artificial Sequence: Synthetic polypeptide

SEQ ID NO: 17119 - protein, 32 aa, Artificial Sequence; identical to SEQ ID NO: 1346
  Description of Artificial Sequence: Synthetic polypeptide

SEQ ID NO: 17120 - protein, 32 aa, Artificial Sequence; identical to SEQ ID NO: 1350
  Description of Artificial Sequence: Synthetic polypeptide

SEQ ID NO: 17121 - protein, 32 aa, Artificial Sequence; identical to SEQ ID NO: 1346
  Description of Artificial Sequence: Synthetic polypeptide

SEQ ID NO: 17122 - protein, 32 aa, Artificial Sequence; identical to SEQ ID NO: 1346
  Description of Artificial Sequence: Synthetic polypeptide

SEQ ID NO: 17123 - protein, 32 aa, Artificial Sequence; identical to SEQ ID NO: 1346
  Description of Artificial Sequence: Synthetic polypeptide

SEQ ID NO: 17124 - protein, 32 aa, Artificial Sequence; identical to SEQ ID NO: 1374
  Description of Artificial Sequence: Synthetic polypeptide

SEQ ID NO: 17125 - protein, 32 aa, Artificial Sequence; identical to SEQ ID NO: 1374
  Description of Artificial Sequence: Synthetic polypeptide

SEQ ID NO: 17126 - protein, 32 aa, Artificial Sequence; identical to SEQ ID NO: 1374
  Description of Artificial Sequence: Synthetic polypeptide

SEQ ID NO: 17127 - protein, 32 aa, Artificial Sequence; identical to SEQ ID NO: 1374
  Description of Artificial Sequence: Synthetic polypeptide

SEQ ID NO: 17128 - protein, 32 aa, Artificial Sequence; identical to SEQ ID NO: 1374
  Description of Artificial Sequence: Synthetic polypeptide

SEQ ID NO: 17129 - protein, 32 aa, Artificial Sequence; identical to SEQ ID NO: 1374
  Description of Artificial Sequence: Synthetic polypeptide

SEQ ID NO: 17130 - protein, 32 aa, Artificial Sequence; identical to SEQ ID NO: 1374
  Description of Artificial Sequence: Synthetic polypeptide

SEQ ID NO: 17131 - protein, 32 aa, Artificial Sequence; identical to SEQ ID NO: 1374
  Description of Artificial Sequence: Synthetic polypeptide

SEQ ID NO: 17132 - protein, 32 aa, Artificial Sequence; identical to SEQ ID NO: 1379
  Description of Artificial Sequence: Synthetic polypeptide

SEQ ID NO: 17133 - protein, 32 aa, Artificial Sequence; identical to SEQ ID NO: 1427
  Description of Artificial Sequence: Synthetic polypeptide

SEQ ID NO: 17134 - protein, 32 aa, Artificial Sequence; identical to SEQ ID NO: 1428
  Description of Artificial Sequence: Synthetic polypeptide

SEQ ID NO: 17135 - protein, 32 aa, Artificial Sequence; identical to SEQ ID NO: 1428
  Description of Artificial Sequence: Synthetic polypeptide

SEQ ID NO: 17136 - protein, 32 aa, Artificial Sequence; identical to SEQ ID NO: 1432
  Description of Artificial Sequence: Synthetic polypeptide

SEQ ID NO: 17137 - protein, 32 aa, Artificial Sequence; identical to SEQ ID NO: 1434
  Description of Artificial Sequence: Synthetic polypeptide

SEQ ID NO: 17138 - protein, 32 aa, Artificial Sequence; identical to SEQ ID NO: 1428
  Description of Artificial Sequence: Synthetic polypeptide

SEQ ID NO: 17139 - protein, 32 aa, Artificial Sequence; identical to SEQ ID NO: 1504
  Description of Artificial Sequence: Synthetic polypeptide

SEQ ID NO: 17140 - protein, 32 aa, Artificial Sequence; identical to SEQ ID NO: 1505
  Description of Artificial Sequence: Synthetic polypeptide

SEQ ID NO: 17141 - protein, 32 aa, Artificial Sequence; identical to SEQ ID NO: 1505
  Description of Artificial Sequence: Synthetic polypeptide

SEQ ID NO: 17142 - protein, 32 aa, Artificial Sequence; identical to SEQ ID NO: 1480
  Description of Artificial Sequence: Synthetic polypeptide

SEQ ID NO: 17143 - protein, 32 aa, Artificial Sequence; identical to SEQ ID NO: 1481
  Description of Artificial Sequence: Synthetic polypeptide

SEQ ID NO: 17144 - protein, 32 aa, Artificial Sequence; identical to SEQ ID NO: 1480
  Description of Artificial Sequence: Synthetic polypeptide

SEQ ID NO: 17145 - protein, 32 aa, Artificial Sequence; identical to SEQ ID NO: 1480
  Description of Artificial Sequence: Synthetic polypeptide

SEQ ID NO: 17146 - protein, 32 aa, Artificial Sequence; identical to SEQ ID NO: 1478
  Description of Artificial Sequence: Synthetic polypeptide

SEQ ID NO: 17147 - protein, 32 aa, Artificial Sequence; identical to SEQ ID NO: 1479
  Description of Artificial Sequence: Synthetic polypeptide

SEQ ID NO: 17148 - protein, 32 aa, Artificial Sequence; identical to SEQ ID NO: 1479
  Description of Artificial Sequence: Synthetic polypeptide

SEQ ID NO: 17149 - protein, 32 aa, Artificial Sequence; identical to SEQ ID NO: 1490
  Description of Artificial Sequence: Synthetic polypeptide

SEQ ID NO: 17150 - protein, 32 aa, Artificial Sequence; identical to SEQ ID NO: 1479
  Description of Artificial Sequence: Synthetic polypeptide

SEQ ID NO: 17151 - protein, 9 aa, Artificial Sequence
  Description of Artificial Sequence: Synthetic peptide
QQSYSTPFT

SEQ ID NO: 17152 - protein, 9 aa, Artificial Sequence
  Description of Artificial Sequence: Synthetic peptide
QQSYSSPFT

SEQ ID NO: 17153 - protein, 9 aa, Artificial Sequence
  Description of Artificial Sequence: Synthetic peptide
QQSYITPFT

SEQ ID NO: 17154 - protein, 9 aa, Artificial Sequence
  Description of Artificial Sequence: Synthetic peptide
QQTYSMPFT

SEQ ID NO: 17155 - protein, 9 aa, Artificial Sequence
  Description of Artificial Sequence: Synthetic peptide
QQSYSTPWT

SEQ ID NO: 17156 - protein, 9 aa, Artificial Sequence
  Description of Artificial Sequence: Synthetic peptide
QQSYYYPTL

SEQ ID NO: 17157 - protein, 9 aa, Artificial Sequence
  Description of Artificial Sequence: Synthetic peptide
QQSYFPVVE

SEQ ID NO: 17158 - protein, 9 aa, Artificial Sequence
  Description of Artificial Sequence: Synthetic peptide
QQSYSTPYT

SEQ ID NO: 17159 - protein, 9 aa, Artificial Sequence
  Description of Artificial Sequence: Synthetic peptide
QQTYSSPFT

SEQ ID NO: 17160 - protein, 11 aa, Artificial Sequence
  Description of Artificial Sequence: Synthetic peptide
QVWDSSSDHVV

SEQ ID NO: 17161 - protein, 11 aa, Artificial Sequence
  Description of Artificial Sequence: Synthetic peptide
QVWDYSPLRHV

SEQ ID NO: 17162 - protein, 12 aa, Artificial Sequence
  Description of Artificial Sequence: Synthetic peptide
QVWDSSLSYGTV

SEQ ID NO: 17163 - protein, 11 aa, Artificial Sequence
  Description of Artificial Sequence: Synthetic peptide
QVWDYYSNRAV

SEQ ID NO: 17164 - protein, 12 aa, Artificial Sequence
  Description of Artificial Sequence: Synthetic peptide
QVWDASAGYGVV

SEQ ID NO: 17165 - protein, 11 aa, Artificial Sequence
  Description of Artificial Sequence: Synthetic peptide
QVWDYSGQRQV

SEQ ID NO: 17166 - protein, 11 aa, Artificial Sequence
  Description of Artificial Sequence: Synthetic peptide
QVWDYVAPRHV

SEQ ID NO: 17167 - protein, 11 aa, Artificial Sequence
  Description of Artificial Sequence: Synthetic peptide
QVWDSSSDHWV

SEQ ID NO: 17168 - protein, 11 aa, Artificial Sequence
  Description of Artificial Sequence: Synthetic peptide
QVWDYRTLDWV

SEQ ID NO: 17169 - protein, 10 aa, Artificial Sequence
  Description of Artificial Sequence: Synthetic peptide
GIAVAGYFDY

SEQ ID NO: 17170 - protein, 10 aa, Artificial Sequence
  Description of Artificial Sequence: Synthetic peptide
GKGVHLGFDY

SEQ ID NO: 17171 - protein, 10 aa, Artificial Sequence
  Description of Artificial Sequence: Synthetic peptide
GKGVHLGFDY

SEQ ID NO: 17172 - protein, 10 aa, Artificial Sequence
  Description of Artificial Sequence: Synthetic peptide
GKGVHLGFDY

SEQ ID NO: 17173 - protein, 10 aa, Artificial Sequence
  Description of Artificial Sequence: Synthetic peptide
GKGVHLGFDY

SEQ ID NO: 17174 - protein, 10 aa, Artificial Sequence
  Description of Artificial Sequence: Synthetic peptide
GKGVHLGFDY

SEQ ID NO: 17175 - protein, 9 aa, Artificial Sequence
  Description of Artificial Sequence: Synthetic peptide
YNWNDYFDY

SEQ ID NO: 17176 - protein, 8 aa, Artificial Sequence
  Description of Artificial Sequence: Synthetic peptide
YNYGHFDY

SEQ ID NO: 17177 - protein, 8 aa, Artificial Sequence
  Description of Artificial Sequence: Synthetic peptide
YNYGHFDY

SEQ ID NO: 17178 - protein, 19 aa, Artificial Sequence
  Description of Artificial Sequence: Synthetic peptide
YYYGSGSYYNYYYYYGMDV

SEQ ID NO: 17179 - protein, 16 aa, Artificial Sequence
  Description of Artificial Sequence: Synthetic peptide
PSYSGSYYNYFSVMDV

SEQ ID NO: 17180 - protein, 16 aa, Artificial Sequence
  Description of Artificial Sequence: Synthetic peptide
PSYSGSYYNYFSVMDV

SEQ ID NO: 17181 - protein, 16 aa, Artificial Sequence
  Description of Artificial Sequence: Synthetic peptide
PSYSGSYYNYFSVMDV

SEQ ID NO: 17182 - protein, 8 aa, Artificial Sequence
  Description of Artificial Sequence: Synthetic peptide
LLLNWFDP

SEQ ID NO: 17183 - protein, 13 aa, Artificial Sequence
  Description of Artificial Sequence: Synthetic peptide
RRYNWNYENWFDP

SEQ ID NO: 17184 - protein, 13 aa, Artificial Sequence
  Description of Artificial Sequence: Synthetic peptide
RRYNWNYENWFDP

SEQ ID NO: 17185 - protein, 8 aa, Artificial Sequence
  Description of Artificial Sequence: Synthetic peptide
LLLNWFDP

SEQ ID NO: 17186 - protein, 13 aa, Artificial Sequence
  Description of Artificial Sequence: Synthetic peptide
RRYNWNYENWFDP

SEQ ID NO: 17187 - protein, 10 aa, Artificial Sequence
  Description of Artificial Sequence: Synthetic peptide
FGPGTKVDIK

SEQ ID NO: 17188 - protein, 10 aa, Artificial Sequence
  Description of Artificial Sequence: Synthetic peptide
FGPGTKVEIK

SEQ ID NO: 17189 - protein, 10 aa, Artificial Sequence
  Description of Artificial Sequence: Synthetic peptide
FGPGTKVEIK

SEQ ID NO: 17190 - protein, 10 aa, Artificial Sequence
  Description of Artificial Sequence: Synthetic peptide
FGPGTKVDIK

SEQ ID NO: 17191 - protein, 10 aa, Artificial Sequence
  Description of Artificial Sequence: Synthetic peptide
FGQGTKVEIK

SEQ ID NO: 17192 - protein, 10 aa, Artificial Sequence
  Description of Artificial Sequence: Synthetic peptide
FGPGTKVEIK

SEQ ID NO: 17193 - protein, 10 aa, Artificial Sequence
  Description of Artificial Sequence: Synthetic peptide
FGPGTKVEIK

SEQ ID NO: 17194 - protein, 10 aa, Artificial Sequence
  Description of Artificial Sequence: Synthetic peptide
FGQGTKLEIK

SEQ ID NO: 17195 - protein, 10 aa, Artificial Sequence
  Description of Artificial Sequence: Synthetic peptide
FGPGTKLEIK

SEQ ID NO: 17196 - protein, 10 aa, Artificial Sequence
  Description of Artificial Sequence: Synthetic peptide
FGGGTKLTVL

SEQ ID NO: 17197 - protein, 10 aa, Artificial Sequence
  Description of Artificial Sequence: Synthetic peptide
FGGGTKLTVL

SEQ ID NO: 17198 - protein, 10 aa, Artificial Sequence
  Description of Artificial Sequence: Synthetic peptide
FGGGTKLTVL

SEQ ID NO: 17199 - protein, 10 aa, Artificial Sequence
  Description of Artificial Sequence: Synthetic peptide
FGGGTKLTVL

SEQ ID NO: 17200 - protein, 10 aa, Artificial Sequence
  Description of Artificial Sequence: Synthetic peptide
FGGGTKLTVL

SEQ ID NO: 17201 - protein, 10 aa, Artificial Sequence
  Description of Artificial Sequence: Synthetic peptide
FGGGTKLTVL

SEQ ID NO: 17202 - protein, 10 aa, Artificial Sequence
  Description of Artificial Sequence: Synthetic peptide
FGGGTKLTVL

SEQ ID NO: 17203 - protein, 10 aa, Artificial Sequence
  Description of Artificial Sequence: Synthetic peptide
FGGGTKLTVL

SEQ ID NO: 17204 - protein, 10 aa, Artificial Sequence
  Description of Artificial Sequence: Synthetic peptide
FGGGTKLTVL

SEQ ID NO: 17205 - protein, 11 aa, Artificial Sequence
  Description of Artificial Sequence: Synthetic peptide
WGQGTLVTVSS

SEQ ID NO: 17206 - protein, 11 aa, Artificial Sequence
  Description of Artificial Sequence: Synthetic peptide
WGQGTLVTVSS

SEQ ID NO: 17207 - protein, 11 aa, Artificial Sequence
  Description of Artificial Sequence: Synthetic peptide
WGQGTLVTVSS

SEQ ID NO: 17208 - protein, 11 aa, Artificial Sequence
  Description of Artificial Sequence: Synthetic peptide
WGQGTLVTVSS

SEQ ID NO: 17209 - protein, 11 aa, Artificial Sequence
  Description of Artificial Sequence: Synthetic peptide
WGQGTLVTVSS

SEQ ID NO: 17210 - protein, 11 aa, Artificial Sequence
  Description of Artificial Sequence: Synthetic peptide
WGQGTLVTVSS

SEQ ID NO: 17211 - protein, 11 aa, Artificial Sequence
  Description of Artificial Sequence: Synthetic peptide
WGQGTLVTVSS

SEQ ID NO: 17212 - protein, 11 aa, Artificial Sequence
  Description of Artificial Sequence: Synthetic peptide
WGQGTLVTVSS

SEQ ID NO: 17213 - protein, 11 aa, Artificial Sequence
  Description of Artificial Sequence: Synthetic peptide
WGQGTLVTVSS

SEQ ID NO: 17214 - protein, 11 aa, Artificial Sequence
  Description of Artificial Sequence: Synthetic peptide
WGQGTTVTVSS

SEQ ID NO: 17215 - protein, 11 aa, Artificial Sequence
  Description of Artificial Sequence: Synthetic peptide
WGQGTTVTVSS

SEQ ID NO: 17216 - protein, 11 aa, Artificial Sequence
  Description of Artificial Sequence: Synthetic peptide
WGQGTTVTVSS

SEQ ID NO: 17217 - protein, 11 aa, Artificial Sequence
  Description of Artificial Sequence: Synthetic peptide
WGQGTTVTVSS

SEQ ID NO: 17218 - protein, 11 aa, Artificial Sequence
  Description of Artificial Sequence: Synthetic peptide
WGQGTLVTVSS

SEQ ID NO: 17219 - protein, 11 aa, Artificial Sequence
  Description of Artificial Sequence: Synthetic peptide
WGQGTLVTVSS

SEQ ID NO: 17220 - protein, 11 aa, Artificial Sequence
  Description of Artificial Sequence: Synthetic peptide
WGQGTLVTVSS

SEQ ID NO: 17221 - protein, 11 aa, Artificial Sequence
  Description of Artificial Sequence: Synthetic peptide
WGQGTLVTVSS

SEQ ID NO: 17222 - protein, 11 aa, Artificial Sequence
  Description of Artificial Sequence: Synthetic peptide
WGQGTLVTVSS

SEQ ID NO: 17223 - protein, 249 aa, Artificial Sequence
  Description of Artificial Sequence: Synthetic polypeptide
EVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVL

SEQ ID NO: 17224 - protein, 14 aa, Artificial Sequence
  Description of Artificial Sequence: Synthetic peptide
GSSTGAVTSGNYPN

SEQ ID NO: 17225 - protein, 5 aa, Artificial Sequence
  Description of Artificial Sequence: Synthetic peptide
KYAIN

SEQ ID NO: 17226 - protein, 7 aa, Artificial Sequence
  Description of Artificial Sequence: Synthetic peptide
GTKFLAP

SEQ ID NO: 17227 - protein, 19 aa, Artificial Sequence
  Description of Artificial Sequence: Synthetic peptide
RIRSKYNNYATYYADAVKD

SEQ ID NO: 17228 - protein, 9 aa, Artificial Sequence
  Description of Artificial Sequence: Synthetic peptide
VLWYSNRWV

SEQ ID NO: 17229 - protein, 14 aa, Artificial Sequence
  Description of Artificial Sequence: Synthetic peptide
AGNFGSSYISYWAY

SEQ ID NO: 17230 - protein, 109 aa, Artificial Sequence
  Description of Artificial Sequence: Synthetic polypeptide
QTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVL

SEQ ID NO: 17231 - protein, 125 aa, Artificial Sequence
  Description of Artificial Sequence: Synthetic polypeptide
EVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSS

SEQ ID NO: 17232 - protein, 22 aa, Artificial Sequence
  Description of Artificial Sequence: Synthetic peptide
QTVVTQEPSLTVSPGGTVTLTC

SEQ ID NO: 17233 - protein, 22 aa, Artificial Sequence
  Description of Artificial Sequence: Synthetic peptide
QTVVTQEPSLTVSPGGTVTITC

SEQ ID NO: 17234 - protein, 30 aa, Artificial Sequence; identical to SEQ ID NO: 793
  Description of Artificial Sequence: Synthetic polypeptide

SEQ ID NO: 17235 - protein, 30 aa, Artificial Sequence; identical to SEQ ID NO: 794
  Description of Artificial Sequence: Synthetic polypeptide

SEQ ID NO: 17236 - protein, 14 aa, Artificial Sequence
  Description of Artificial Sequence: Synthetic peptide
ASSTGAVTSGYYPN

SEQ ID NO: 17237 - protein, 14 aa, Artificial Sequence
  Description of Artificial Sequence: Synthetic peptide
GSSTGAVTSGNYPN

SEQ ID NO: 17238 - protein, 5 aa, Artificial Sequence
  Description of Artificial Sequence: Synthetic peptide
GSAMH

SEQ ID NO: 17239 - protein, 5 aa, Artificial Sequence
  Description of Artificial Sequence: Synthetic peptide
KYAIN

SEQ ID NO: 17240 - protein, 15 aa, Artificial Sequence
  Description of Artificial Sequence: Synthetic peptide
WFQQKPGQAPRALIY

SEQ ID NO: 17241 - protein, 15 aa, Artificial Sequence
  Description of Artificial Sequence: Synthetic peptide
WVQKKPGQAPRGLIG

SEQ ID NO: 17242 - protein, 14 aa, Artificial Sequence
  Description of Artificial Sequence: Synthetic peptide
WVRQASGKGLEWVG

SEQ ID NO: 17243 - protein, 14 aa, Artificial Sequence
  Description of Artificial Sequence: Synthetic peptide
WVRQAPGKGLEWVA

SEQ ID NO: 17244 - protein, 7 aa, Artificial Sequence
  Description of Artificial Sequence: Synthetic peptide
STSNKHS

SEQ ID NO: 17245 - protein, 7 aa, Artificial Sequence
  Description of Artificial Sequence: Synthetic peptide
GTKFLAP

SEQ ID NO: 17246 - protein, 19 aa, Artificial Sequence
  Description of Artificial Sequence: Synthetic peptide
RIRSKANSYATAYAASVKG

SEQ ID NO: 17247 - protein, 19 aa, Artificial Sequence
  Description of Artificial Sequence: Synthetic peptide
RIRSKYNNYATYYADAVKD

SEQ ID NO: 17248 - protein, 32 aa, Artificial Sequence; identical to SEQ ID NO: 1385
  Description of Artificial Sequence: Synthetic polypeptide

SEQ ID NO: 17249 - protein, 32 aa, Artificial Sequence
  Description of Artificial Sequence: Synthetic polypeptide
GTPARFSGSLSGGKAALTLSGVQPEDEAEYYC

SEQ ID NO: 17250 - protein, 32 aa, Artificial Sequence; identical to SEQ ID NO: 1441
  Description of Artificial Sequence: Synthetic polypeptide

SEQ ID NO: 17251 - protein, 32 aa, Artificial Sequence
  Description of Artificial Sequence: Synthetic polypeptide
RFTISRDDSKNTVYLQMNNLKTEDTAVYYCAR

SEQ ID NO: 17252 - protein, 10 aa, Artificial Sequence
  Description of Artificial Sequence: Synthetic peptide
LLYYGGAQWV

SEQ ID NO: 17253 - protein, 9 aa, Artificial Sequence
  Description of Artificial Sequence: Synthetic peptide
VLWYSNRWV

SEQ ID NO: 17254 - protein, 13 aa, Artificial Sequence
  Description of Artificial Sequence: Synthetic peptide
AYCGGDCYSYFDY

SEQ ID NO: 17255 - protein, 14 aa, Artificial Sequence
  Description of Artificial Sequence: Synthetic peptide
AGNFGSSYISYWAY

SEQ ID NO: 17256 - protein, 10 aa, Artificial Sequence
  Description of Artificial Sequence: Synthetic peptide
FGGGTKLTVL

SEQ ID NO: 17257 - protein, 10 aa, Artificial Sequence
  Description of Artificial Sequence: Synthetic peptide
FGSGTKLTVL

SEQ ID NO: 17258 - protein, 11 aa, Artificial Sequence
  Description of Artificial Sequence: Synthetic peptide
WGQGTLVTVSS

SEQ ID NO: 17259 - protein, 11 aa, Artificial Sequence
  Description of Artificial Sequence: Synthetic peptide
WGQGTLVTVSS

SEQ ID NO: 17260 - protein, 22 aa, Artificial Sequence
  Description of Artificial Sequence: Synthetic peptide
QTVVTQEPSLTVSPGGTVTLTC

SEQ ID NO: 17261 - protein, 22 aa, Artificial Sequence
  Description of Artificial Sequence: Synthetic peptide
QTVVTQEPSLTVSPGGTVTITC

SEQ ID NO: 17262 - protein, 30 aa, Artificial Sequence; identical to SEQ ID NO: 793
  Description of Artificial Sequence: Synthetic polypeptide

SEQ ID NO: 17263 - protein, 30 aa, Artificial Sequence; identical to SEQ ID NO: 794
  Description of Artificial Sequence: Synthetic polypeptide

SEQ ID NO: 17264 - protein, 14 aa, Artificial Sequence
  Description of Artificial Sequence: Synthetic peptide
ASSTGAVTSGYYPN

SEQ ID NO: 17265 - protein, 14 aa, Artificial Sequence
  Description of Artificial Sequence: Synthetic peptide
GSSTGAVTSGNYPN

SEQ ID NO: 17266 - protein, 5 aa, Artificial Sequence
  Description of Artificial Sequence: Synthetic peptide
GSAMH

SEQ ID NO: 17267 - protein, 5 aa, Artificial Sequence
  Description of Artificial Sequence: Synthetic peptide
KYAIN

SEQ ID NO: 17268 - protein, 15 aa, Artificial Sequence
  Description of Artificial Sequence: Synthetic peptide
WFQQKPGQAPRALIY

SEQ ID NO: 17269 - protein, 15 aa, Artificial Sequence
  Description of Artificial Sequence: Synthetic peptide
WVQKKPGQAPRGLIG

SEQ ID NO: 17270 - protein, 14 aa, Artificial Sequence
  Description of Artificial Sequence: Synthetic peptide
WVRQASGKGLEWVG

SEQ ID NO: 17271 - protein, 14 aa, Artificial Sequence
  Description of Artificial Sequence: Synthetic peptide
WVRQAPGKGLEWVA

SEQ ID NO: 17272 - protein, 7 aa, Artificial Sequence
  Description of Artificial Sequence: Synthetic peptide
STSNKHS

SEQ ID NO: 17273 - protein, 7 aa, Artificial Sequence
  Description of Artificial Sequence: Synthetic peptide
GTKFLAP

SEQ ID NO: 17274 - protein, 19 aa, Artificial Sequence
  Description of Artificial Sequence: Synthetic peptide
RIRSKANSYATAYAASVKG

SEQ ID NO: 17275 - protein, 19 aa, Artificial Sequence
  Description of Artificial Sequence: Synthetic peptide
RIRSKYNNYATYYADAVKD

SEQ ID NO: 17276 - protein, 32 aa, Artificial Sequence; identical to SEQ ID NO: 1385
  Description of Artificial Sequence: Synthetic polypeptide

SEQ ID NO: 17277 - protein, 32 aa, Artificial Sequence; identical to SEQ ID NO: 17249
  Description of Artificial Sequence: Synthetic polypeptide

SEQ ID NO: 17278 - protein, 32 aa, Artificial Sequence; identical to SEQ ID NO: 1441
  Description of Artificial Sequence: Synthetic polypeptide

SEQ ID NO: 17279 - protein, 32 aa, Artificial Sequence; identical to SEQ ID NO: 17251
  Description of Artificial Sequence: Synthetic polypeptide

SEQ ID NO: 17280 - protein, 10 aa, Artificial Sequence
  Description of Artificial Sequence: Synthetic peptide
LLYYGGAQWV

SEQ ID NO: 17281 - protein, 9 aa, Artificial Sequence
  Description of Artificial Sequence: Synthetic peptide
VLWYSNRWV

SEQ ID NO: 17282 - protein, 13 aa, Artificial Sequence
  Description of Artificial Sequence: Synthetic peptide
AYCGGDCYSYFDY

SEQ ID NO: 17283 - protein, 14 aa, Artificial Sequence
  Description of Artificial Sequence: Synthetic peptide
AGNFGSSYISYWAY

SEQ ID NO: 17284 - protein, 10 aa, Artificial Sequence
  Description of Artificial Sequence: Synthetic peptide
FGGGTKLTVL

SEQ ID NO: 17285 - protein, 10 aa, Artificial Sequence
  Description of Artificial Sequence: Synthetic peptide
FGSGTKLTVL

SEQ ID NO: 17286 - protein, 11 aa, Artificial Sequence
  Description of Artificial Sequence: Synthetic peptide
WGQGTLVTVSS

SEQ ID NO: 17287 - protein, 11 aa, Artificial Sequence
  Description of Artificial Sequence: Synthetic peptide
WGQGTLVTVSS

SEQ ID NO: 17288 - protein, 737 aa, Artificial Sequence
  Description of Artificial Sequence: Synthetic polypeptide
EVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLGGGGDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17289 - protein, 737 aa, Artificial Sequence
  Description of Artificial Sequence: Synthetic polypeptide
EVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17290 - protein, 14 aa, Artificial Sequence
  Description of Artificial Sequence: Synthetic peptide
GSSTGAVTSGNYPN

SEQ ID NO: 17291 - protein, 14 aa, Artificial Sequence
  Description of Artificial Sequence: Synthetic peptide
GSSTGAVTSGNYPN

SEQ ID NO: 17292 - protein, 5 aa, Artificial Sequence
  Description of Artificial Sequence: Synthetic peptide
KYAIN

SEQ ID NO: 17293 - protein, 5 aa, Artificial Sequence
  Description of Artificial Sequence: Synthetic peptide
KYAIN

SEQ ID NO: 17294 - protein, 7 aa, Artificial Sequence
  Description of Artificial Sequence: Synthetic peptide
GTKFLAP

SEQ ID NO: 17295 - protein, 7 aa, Artificial Sequence
  Description of Artificial Sequence: Synthetic peptide
GTKFLAP

SEQ ID NO: 17296 - protein, 19 aa, Artificial Sequence
  Description of Artificial Sequence: Synthetic peptide
RIRSKYNNYATYYADAVKD

SEQ ID NO: 17297 - protein, 19 aa, Artificial Sequence
  Description of Artificial Sequence: Synthetic peptide
RIRSKYNNYATYYADAVKD

SEQ ID NO: 17298 - protein, 9 aa, Artificial Sequence
  Description of Artificial Sequence: Synthetic peptide
VLWYSNRWV

SEQ ID NO: 17299 - protein, 9 aa, Artificial Sequence
  Description of Artificial Sequence: Synthetic peptide
VLWYSNRWV

SEQ ID NO: 17300 - protein, 14 aa, Artificial Sequence
  Description of Artificial Sequence: Synthetic peptide
AGNFGSSYISYWAY

SEQ ID NO: 17301 - protein, 14 aa, Artificial Sequence
  Description of Artificial Sequence: Synthetic peptide
AGNFGSSYISYWAY

SEQ ID NO: 17302 - protein, 109 aa, Artificial Sequence; identical to SEQ ID NO: 17230
  Description of Artificial Sequence: Synthetic polypeptide

SEQ ID NO: 17303 - protein, 109 aa, Artificial Sequence; identical to SEQ ID NO: 17230
  Description of Artificial Sequence: Synthetic polypeptide

SEQ ID NO: 17304 - protein, 125 aa, Artificial Sequence; identical to SEQ ID NO: 17231
  Description of Artificial Sequence: Synthetic polypeptide

SEQ ID NO: 17305 - protein, 125 aa, Artificial Sequence; identical to SEQ ID NO: 17231
  Description of Artificial Sequence: Synthetic polypeptide

SEQ ID NO: 17306 - protein, 22 aa, Artificial Sequence
  Description of Artificial Sequence: Synthetic peptide
QTVVTQEPSLTVSPGGTVTLTC

SEQ ID NO: 17307 - protein, 22 aa, Artificial Sequence
  Description of Artificial Sequence: Synthetic peptide
QTVVTQEPSLTVSPGGTVTITC

SEQ ID NO: 17308 - protein, 22 aa, Artificial Sequence
  Description of Artificial Sequence: Synthetic peptide
QTVVTQEPSLTVSPGGTVTITC

SEQ ID NO: 17309 - protein, 30 aa, Artificial Sequence; identical to SEQ ID NO: 793
  Description of Artificial Sequence: Synthetic polypeptide

SEQ ID NO: 17310 - protein, 30 aa, Artificial Sequence; identical to SEQ ID NO: 794
  Description of Artificial Sequence: Synthetic polypeptide

SEQ ID NO: 17311 - protein, 30 aa, Artificial Sequence; identical to SEQ ID NO: 794
  Description of Artificial Sequence: Synthetic polypeptide

SEQ ID NO: 17312 - protein, 14 aa, Artificial Sequence
  Description of Artificial Sequence: Synthetic peptide
ASSTGAVTSGYYPN

SEQ ID NO: 17313 - protein, 14 aa, Artificial Sequence
  Description of Artificial Sequence: Synthetic peptide
GSSTGAVTSGNYPN

SEQ ID NO: 17314 - protein, 14 aa, Artificial Sequence
  Description of Artificial Sequence: Synthetic peptide
GSSTGAVTSGNYPN

SEQ ID NO: 17315 - protein, 5 aa, Artificial Sequence
  Description of Artificial Sequence: Synthetic peptide
GSAMH

SEQ ID NO: 17316 - protein, 5 aa, Artificial Sequence
  Description of Artificial Sequence: Synthetic peptide
KYAIN

SEQ ID NO: 17317 - protein, 5 aa, Artificial Sequence
  Description of Artificial Sequence: Synthetic peptide
KYAIN

SEQ ID NO: 17318 - protein, 15 aa, Artificial Sequence
  Description of Artificial Sequence: Synthetic peptide
WFQQKPGQAPRALIY

SEQ ID NO: 17319 - protein, 15 aa, Artificial Sequence
  Description of Artificial Sequence: Synthetic peptide
WVQKKPGQAPRGLIG

SEQ ID NO: 17320 - protein, 15 aa, Artificial Sequence
  Description of Artificial Sequence: Synthetic peptide
WVQKKPGQAPRGLIG

SEQ ID NO: 17321 - protein, 14 aa, Artificial Sequence
  Description of Artificial Sequence: Synthetic peptide
WVRQASGKGLEWVG

SEQ ID NO: 17322 - protein, 14 aa, Artificial Sequence
  Description of Artificial Sequence: Synthetic peptide
WVRQAPGKGLEWVA

SEQ ID NO: 17323 - protein, 14 aa, Artificial Sequence
  Description of Artificial Sequence: Synthetic peptide
WVRQAPGKGLEWVA

SEQ ID NO: 17324 - protein, 7 aa, Artificial Sequence
  Description of Artificial Sequence: Synthetic peptide
STSNKHS

SEQ ID NO: 17325 - protein, 7 aa, Artificial Sequence
  Description of Artificial Sequence: Synthetic peptide
GTKFLAP

SEQ ID NO: 17326 - protein, 7 aa, Artificial Sequence
  Description of Artificial Sequence: Synthetic peptide
GTKFLAP

SEQ ID NO: 17327 - protein, 19 aa, Artificial Sequence
  Description of Artificial Sequence: Synthetic peptide
RIRSKANSYATAYAASVKG

SEQ ID NO: 17328 - protein, 19 aa, Artificial Sequence
  Description of Artificial Sequence: Synthetic peptide
RIRSKYNNYATYYADAVKD

SEQ ID NO: 17329 - protein, 19 aa, Artificial Sequence
  Description of Artificial Sequence: Synthetic peptide
RIRSKYNNYATYYADAVKD

SEQ ID NO: 17330 - protein, 32 aa, Artificial Sequence; identical to SEQ ID NO: 1385
  Description of Artificial Sequence: Synthetic polypeptide

SEQ ID NO: 17331 - protein, 32 aa, Artificial Sequence; identical to SEQ ID NO: 17249
  Description of Artificial Sequence: Synthetic polypeptide

SEQ ID NO: 17332 - protein, 32 aa, Artificial Sequence; identical to SEQ ID NO: 17249
  Description of Artificial Sequence: Synthetic polypeptide

SEQ ID NO: 17333 - protein, 32 aa, Artificial Sequence; identical to SEQ ID NO: 1441
  Description of Artificial Sequence: Synthetic polypeptide

SEQ ID NO: 17334 - protein, 32 aa, Artificial Sequence; identical to SEQ ID NO: 17251
  Description of Artificial Sequence: Synthetic polypeptide

SEQ ID NO: 17335 - protein, 32 aa, Artificial Sequence; identical to SEQ ID NO: 17251
  Description of Artificial Sequence: Synthetic polypeptide

SEQ ID NO: 17336 - protein, 10 aa, Artificial Sequence
  Description of Artificial Sequence: Synthetic peptide
LLYYGGAQWV

SEQ ID NO: 17337 - protein, 9 aa, Artificial Sequence
  Description of Artificial Sequence: Synthetic peptide
VLWYSNRWV

SEQ ID NO: 17338 - protein, 9 aa, Artificial Sequence
  Description of Artificial Sequence: Synthetic peptide
VLWYSNRWV

SEQ ID NO: 17339 - protein, 13 aa, Artificial Sequence
  Description of Artificial Sequence: Synthetic peptide
AYCGGDCYSYFDY

SEQ ID NO: 17340 - protein, 14 aa, Artificial Sequence
  Description of Artificial Sequence: Synthetic peptide
AGNFGSSYISYWAY

SEQ ID NO: 17341 - protein, 14 aa, Artificial Sequence
  Description of Artificial Sequence: Synthetic peptide
AGNFGSSYISYWAY

SEQ ID NO: 17342 - protein, 10 aa, Artificial Sequence
  Description of Artificial Sequence: Synthetic peptide
FGGGTKLTVL

SEQ ID NO: 17343 - protein, 10 aa, Artificial Sequence
  Description of Artificial Sequence: Synthetic peptide
FGSGTKLTVL

SEQ ID NO: 17344 - protein, 10 aa, Artificial Sequence
  Description of Artificial Sequence: Synthetic peptide
FGSGTKLTVL

SEQ ID NO: 17345 - protein, 11 aa, Artificial Sequence
  Description of Artificial Sequence: Synthetic peptide
WGQGTLVTVSS

SEQ ID NO: 17346 - protein, 11 aa, Artificial Sequence
  Description of Artificial Sequence: Synthetic peptide
WGQGTLVTVSS

SEQ ID NO: 17347 - protein, 11 aa, Artificial Sequence
  Description of Artificial Sequence: Synthetic peptide
WGQGTLVTVSS

SEQ ID NO: 17348 - protein, 22 aa, Artificial Sequence
  Description of Artificial Sequence: Synthetic peptide
QTVVTQEPSLTVSPGGTVTLTC

SEQ ID NO: 17349 - protein, 22 aa, Artificial Sequence
  Description of Artificial Sequence: Synthetic peptide
QTVVTQEPSLTVSPGGTVTITC

SEQ ID NO: 17350 - protein, 22 aa, Artificial Sequence
  Description of Artificial Sequence: Synthetic peptide
QTVVTQEPSLTVSPGGTVTITC

SEQ ID NO: 17351 - protein, 30 aa, Artificial Sequence; identical to SEQ ID NO: 793
  Description of Artificial Sequence: Synthetic polypeptide

SEQ ID NO: 17352 - protein, 30 aa, Artificial Sequence; identical to SEQ ID NO: 794
  Description of Artificial Sequence: Synthetic polypeptide

SEQ ID NO: 17353 - protein, 30 aa, Artificial Sequence; identical to SEQ ID NO: 794
  Description of Artificial Sequence: Synthetic polypeptide

SEQ ID NO: 17354 - protein, 14 aa, Artificial Sequence
  Description of Artificial Sequence: Synthetic peptide
ASSTGAVTSGYYPN

SEQ ID NO: 17355 - protein, 14 aa, Artificial Sequence
  Description of Artificial Sequence: Synthetic peptide
GSSTGAVTSGNYPN

SEQ ID NO: 17356 - protein, 14 aa, Artificial Sequence
  Description of Artificial Sequence: Synthetic peptide
GSSTGAVTSGNYPN

SEQ ID NO: 17357 - protein, 5 aa, Artificial Sequence
  Description of Artificial Sequence: Synthetic peptide
GSAMH

SEQ ID NO: 17358 - protein, 5 aa, Artificial Sequence
  Description of Artificial Sequence: Synthetic peptide
KYAIN

SEQ ID NO: 17359 - protein, 5 aa, Artificial Sequence
  Description of Artificial Sequence: Synthetic peptide
KYAIN

SEQ ID NO: 17360 - protein, 15 aa, Artificial Sequence
  Description of Artificial Sequence: Synthetic peptide
WFQQKPGQAPRALIY

SEQ ID NO: 17361 - protein, 15 aa, Artificial Sequence
  Description of Artificial Sequence: Synthetic peptide
WVQKKPGQAPRGLIG

SEQ ID NO: 17362 - protein, 15 aa, Artificial Sequence
  Description of Artificial Sequence: Synthetic peptide
WVQKKPGQAPRGLIG

SEQ ID NO: 17363 - protein, 14 aa, Artificial Sequence
  Description of Artificial Sequence: Synthetic peptide
WVRQASGKGLEWVG

SEQ ID NO: 17364 - protein, 14 aa, Artificial Sequence
  Description of Artificial Sequence: Synthetic peptide
WVRQAPGKGLEWVA

SEQ ID NO: 17365 - protein, 14 aa, Artificial Sequence
  Description of Artificial Sequence: Synthetic peptide
WVRQAPGKGLEWVA

SEQ ID NO: 17366 - protein, 7 aa, Artificial Sequence
  Description of Artificial Sequence: Synthetic peptide
STSNKHS

SEQ ID NO: 17367 - protein, 7 aa, Artificial Sequence
  Description of Artificial Sequence: Synthetic peptide
GTKFLAP

SEQ ID NO: 17368 - protein, 7 aa, Artificial Sequence
  Description of Artificial Sequence: Synthetic peptide
GTKFLAP

SEQ ID NO: 17369 - protein, 19 aa, Artificial Sequence
  Description of Artificial Sequence: Synthetic peptide
RIRSKANSYATAYAASVKG

SEQ ID NO: 17370 - protein, 19 aa, Artificial Sequence
  Description of Artificial Sequence: Synthetic peptide
RIRSKYNNYATYYADAVKD

SEQ ID NO: 17371 - protein, 19 aa, Artificial Sequence
  Description of Artificial Sequence: Synthetic peptide
RIRSKYNNYATYYADAVKD

SEQ ID NO: 17372 - protein, 32 aa, Artificial Sequence; identical to SEQ ID NO: 1385
  Description of Artificial Sequence: Synthetic polypeptide

SEQ ID NO: 17373 - protein, 32 aa, Artificial Sequence; identical to SEQ ID NO: 17249
  Description of Artificial Sequence: Synthetic polypeptide

SEQ ID NO: 17374 - protein, 32 aa, Artificial Sequence; identical to SEQ ID NO: 17249
  Description of Artificial Sequence: Synthetic polypeptide

SEQ ID NO: 17375 - protein, 32 aa, Artificial Sequence; identical to SEQ ID NO: 1441
  Description of Artificial Sequence: Synthetic polypeptide

SEQ ID NO: 17376 - protein, 32 aa, Artificial Sequence; identical to SEQ ID NO: 17251
  Description of Artificial Sequence: Synthetic polypeptide

SEQ ID NO: 17377 - protein, 32 aa, Artificial Sequence; identical to SEQ ID NO: 17251
  Description of Artificial Sequence: Synthetic polypeptide

SEQ ID NO: 17378 - protein, 10 aa, Artificial Sequence
  Description of Artificial Sequence: Synthetic peptide
LLYYGGAQWV

SEQ ID NO: 17379 - protein, 9 aa, Artificial Sequence
  Description of Artificial Sequence: Synthetic peptide
VLWYSNRWV

SEQ ID NO: 17380 - protein, 9 aa, Artificial Sequence
  Description of Artificial Sequence: Synthetic peptide
VLWYSNRWV

SEQ ID NO: 17381 - protein, 13 aa, Artificial Sequence
  Description of Artificial Sequence: Synthetic peptide
AYCGGDCYSYFDY

SEQ ID NO: 17382 - protein, 14 aa, Artificial Sequence
  Description of Artificial Sequence: Synthetic peptide
AGNFGSSYISYWAY

SEQ ID NO: 17383 - protein, 14 aa, Artificial Sequence
  Description of Artificial Sequence: Synthetic peptide
AGNFGSSYISYWAY

SEQ ID NO: 17384 - protein, 10 aa, Artificial Sequence
  Description of Artificial Sequence: Synthetic peptide
FGGGTKLTVL

SEQ ID NO: 17385 - protein, 10 aa, Artificial Sequence
  Description of Artificial Sequence: Synthetic peptide
FGSGTKLTVL

SEQ ID NO: 17386 - protein, 10 aa, Artificial Sequence
  Description of Artificial Sequence: Synthetic peptide
FGSGTKLTVL

SEQ ID NO: 17387 - protein, 11 aa, Artificial Sequence
  Description of Artificial Sequence: Synthetic peptide
WGQGTLVTVSS

SEQ ID NO: 17388 - protein, 11 aa, Artificial Sequence
  Description of Artificial Sequence: Synthetic peptide
WGQGTLVTVSS

SEQ ID NO: 17389 - protein, 11 aa, Artificial Sequence
  Description of Artificial Sequence: Synthetic peptide
WGQGTLVTVSS

SEQ ID NO: 17390 - protein, 1007 aa, Artificial Sequence; identical to SEQ ID NO: 47
  Description of Artificial Sequence: Synthetic polypeptide

SEQ ID NO: 17391 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSYAMSWVRQAPGKCLEWVSAISGSGGGTYYAASVKGRFTISRDNSKNTLYLQMSSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGCGTKLTVLSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17392 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSYAMSWVRQAPGKCLEWVSAISGSGGGTYYAASVKGRFTISRDNSKNTLYLQMSSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGCGTKLTVLSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLGGGGDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17393 - protein, 1014 aa, Artificial Sequence; identical to SEQ ID NO: 73
  Description of Artificial Sequence: Synthetic polypeptide

SEQ ID NO: 17394 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRIRSRSYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVEIKSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17395 - protein, 1014 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRIRSRSYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVEIKSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLGGGGDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17396 - protein, 1007 aa, Artificial Sequence; identical to SEQ ID NO: 101
  Description of Artificial Sequence: Synthetic polypeptide

SEQ ID NO: 17397 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSSISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGCGTKLTVLSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17398 - protein, 1007 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSSISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGCGTKLTVLSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLGGGGDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 17399 - protein, 11 aa, Artificial Sequence
  Description of Artificial Sequence: Synthetic peptide
GGNNIGSKSVH

SEQ ID NO: 17400 - protein, 11 aa, Artificial Sequence
  Description of Artificial Sequence: Synthetic peptide
GGNNIGSKSVH

SEQ ID NO: 17401 - protein, 11 aa, Artificial Sequence
  Description of Artificial Sequence: Synthetic peptide
GGNNIGSKSVH

SEQ ID NO: 17402 - protein, 11 aa, Artificial Sequence
  Description of Artificial Sequence: Synthetic peptide
RTSQSISSYLN

SEQ ID NO: 17403 - protein, 11 aa, Artificial Sequence
  Description of Artificial Sequence: Synthetic peptide
RTSQSISSYLN

SEQ ID NO: 17404 - protein, 11 aa, Artificial Sequence
  Description of Artificial Sequence: Synthetic peptide
RTSQSISSYLN

SEQ ID NO: 17405 - protein, 11 aa, Artificial Sequence
  Description of Artificial Sequence: Synthetic peptide
GGNNIGSKSVH

SEQ ID NO: 17406 - protein, 11 aa, Artificial Sequence
  Description of Artificial Sequence: Synthetic peptide
GGNNIGSKSVH

SEQ ID NO: 17407 - protein, 11 aa, Artificial Sequence
  Description of Artificial Sequence: Synthetic peptide
GGNNIGSKSVH

SEQ ID NO: 17408 - protein, 5 aa, Artificial Sequence
  Description of Artificial Sequence: Synthetic peptide
SYAMS

SEQ ID NO: 17409 - protein, 5 aa, Artificial Sequence
  Description of Artificial Sequence: Synthetic peptide
SYAMS

SEQ ID NO: 17410 - protein, 5 aa, Artificial Sequence
  Description of Artificial Sequence: Synthetic peptide
SYAMS

SEQ ID NO: 17411 - protein, 5 aa, Artificial Sequence
  Description of Artificial Sequence: Synthetic peptide
NAWMS

SEQ ID NO: 17412 - protein, 5 aa, Artificial Sequence
  Description of Artificial Sequence: Synthetic peptide
NAWMS

SEQ ID NO: 17413 - protein, 5 aa, Artificial Sequence
  Description of Artificial Sequence: Synthetic peptide
NAWMS

SEQ ID NO: 17414 - protein, 5 aa, Artificial Sequence
  Description of Artificial Sequence: Synthetic peptide
SHAMS

SEQ ID NO: 17415 - protein, 5 aa, Artificial Sequence
  Description of Artificial Sequence: Synthetic peptide
SHAMS

SEQ ID NO: 17416 - protein, 5 aa, Artificial Sequence
  Description of Artificial Sequence: Synthetic peptide
SHAMS

SEQ ID NO: 17417 - protein, 14 aa, Artificial Sequence
  Description of Artificial Sequence: Synthetic peptide
GSSTGAVTSGNYPN

SEQ ID NO: 17418 - protein, 14 aa, Artificial Sequence
  Description of Artificial Sequence: Synthetic peptide
GSSTGAVTSGNYPN

SEQ ID NO: 17419 - protein, 14 aa, Artificial Sequence
  Description of Artificial Sequence: Synthetic peptide
GSSTGAVTSGNYPN

SEQ ID NO: 17420 - protein, 14 aa, Artificial Sequence
  Description of Artificial Sequence: Synthetic peptide
GSSTGAVTSGNYPN

SEQ ID NO: 17421 - protein, 14 aa, Artificial Sequence
  Description of Artificial Sequence: Synthetic peptide
GSSTGAVTSGNYPN

SEQ ID NO: 17422 - protein, 14 aa, Artificial Sequence
  Description of Artificial Sequence: Synthetic peptide
GSSTGAVTSGNYPN

SEQ ID NO: 17423 - protein, 14 aa, Artificial Sequence
  Description of Artificial Sequence: Synthetic peptide
GSSTGAVTSGNYPN

SEQ ID NO: 17424 - protein, 14 aa, Artificial Sequence
  Description of Artificial Sequence: Synthetic peptide
GSSTGAVTSGNYPN

SEQ ID NO: 17425 - protein, 14 aa, Artificial Sequence
  Description of Artificial Sequence: Synthetic peptide
GSSTGAVTSGNYPN

SEQ ID NO: 17426 - protein, 5 aa, Artificial Sequence
  Description of Artificial Sequence: Synthetic peptide
KYAMN

SEQ ID NO: 17427 - protein, 5 aa, Artificial Sequence
  Description of Artificial Sequence: Synthetic peptide
KYAIN

SEQ ID NO: 17428 - protein, 5 aa, Artificial Sequence
  Description of Artificial Sequence: Synthetic peptide
KYAIN

SEQ ID NO: 17429 - protein, 5 aa, Artificial Sequence
  Description of Artificial Sequence: Synthetic peptide
KYAMN

SEQ ID NO: 17430 - protein, 5 aa, Artificial Sequence
  Description of Artificial Sequence: Synthetic peptide
KYAIN

SEQ ID NO: 17431 - protein, 5 aa, Artificial Sequence
  Description of Artificial Sequence: Synthetic peptide
KYAIN

SEQ ID NO: 17432 - protein, 5 aa, Artificial Sequence
  Description of Artificial Sequence: Synthetic peptide
KYAMN

SEQ ID NO: 17433 - protein, 5 aa, Artificial Sequence
  Description of Artificial Sequence: Synthetic peptide
KYAIN

SEQ ID NO: 17434 - protein, 5 aa, Artificial Sequence
  Description of Artificial Sequence: Synthetic peptide
KYAIN

SEQ ID NO: 17435 - protein, 7 aa, Artificial Sequence
  Description of Artificial Sequence: Synthetic peptide
DDNDRPS

SEQ ID NO: 17436 - protein, 7 aa, Artificial Sequence
  Description of Artificial Sequence: Synthetic peptide
DDNDRPS

SEQ ID NO: 17437 - protein, 7 aa, Artificial Sequence
  Description of Artificial Sequence: Synthetic peptide
DDNDRPS

SEQ ID NO: 17438 - protein, 7 aa, Artificial Sequence
  Description of Artificial Sequence: Synthetic peptide
AASSLQG

SEQ ID NO: 17439 - protein, 7 aa, Artificial Sequence
  Description of Artificial Sequence: Synthetic peptide
AASSLQG

SEQ ID NO: 17440 - protein, 7 aa, Artificial Sequence
  Description of Artificial Sequence: Synthetic peptide
AASSLQG

SEQ ID NO: 17441 - protein, 7 aa, Artificial Sequence
  Description of Artificial Sequence: Synthetic peptide
DDNDRPS

SEQ ID NO: 17442 - protein, 7 aa, Artificial Sequence
  Description of Artificial Sequence: Synthetic peptide
DDNDRPS

SEQ ID NO: 17443 - protein, 7 aa, Artificial Sequence
  Description of Artificial Sequence: Synthetic peptide
DDNDRPS

SEQ ID NO: 17444 - protein, 17 aa, Artificial Sequence
  Description of Artificial Sequence: Synthetic peptide
AISGSGGGTYYAASVKG

SEQ ID NO: 17445 - protein, 17 aa, Artificial Sequence
  Description of Artificial Sequence: Synthetic peptide
AISGSGGGTYYAASVKG

SEQ ID NO: 17446 - protein, 17 aa, Artificial Sequence
  Description of Artificial Sequence: Synthetic peptide
AISGSGGGTYYAASVKG

SEQ ID NO: 17447 - protein, 19 aa, Artificial Sequence
  Description of Artificial Sequence: Synthetic peptide
RIRSRSYGGTTDYAAPVKG

SEQ ID NO: 17448 - protein, 19 aa, Artificial Sequence
  Description of Artificial Sequence: Synthetic peptide
RIRSRSYGGTTDYAAPVKG

SEQ ID NO: 17449 - protein, 19 aa, Artificial Sequence
  Description of Artificial Sequence: Synthetic peptide
RIRSRSYGGTTDYAAPVKG

SEQ ID NO: 17450 - protein, 17 aa, Artificial Sequence
  Description of Artificial Sequence: Synthetic peptide
SISGSGGGTYYAASVKG

SEQ ID NO: 17451 - protein, 17 aa, Artificial Sequence
  Description of Artificial Sequence: Synthetic peptide
SISGSGGGTYYAASVKG

SEQ ID NO: 17452 - protein, 17 aa, Artificial Sequence
  Description of Artificial Sequence: Synthetic peptide
SISGSGGGTYYAASVKG

SEQ ID NO: 17453 - protein, 7 aa, Artificial Sequence
  Description of Artificial Sequence: Synthetic peptide
GTKFLAP

SEQ ID NO: 17454 - protein, 7 aa, Artificial Sequence
  Description of Artificial Sequence: Synthetic peptide
GTKFLAP

SEQ ID NO: 17455 - protein, 7 aa, Artificial Sequence
  Description of Artificial Sequence: Synthetic peptide
GTKFLAP

SEQ ID NO: 17456 - protein, 7 aa, Artificial Sequence
  Description of Artificial Sequence: Synthetic peptide
GTKFLAP

SEQ ID NO: 17457 - protein, 7 aa, Artificial Sequence
  Description of Artificial Sequence: Synthetic peptide
GTKFLAP

SEQ ID NO: 17458 - protein, 7 aa, Artificial Sequence
  Description of Artificial Sequence: Synthetic peptide
GTKFLAP

SEQ ID NO: 17459 - protein, 7 aa, Artificial Sequence
  Description of Artificial Sequence: Synthetic peptide
GTKFLAP

SEQ ID NO: 17460 - protein, 7 aa, Artificial Sequence
  Description of Artificial Sequence: Synthetic peptide
GTKFLAP

SEQ ID NO: 17461 - protein, 7 aa, Artificial Sequence
  Description of Artificial Sequence: Synthetic peptide
GTKFLAP

SEQ ID NO: 17462 - protein, 19 aa, Artificial Sequence
  Description of Artificial Sequence: Synthetic peptide
RIRSKYNNYATYYADSVKD

SEQ ID NO: 17463 - protein, 19 aa, Artificial Sequence
  Description of Artificial Sequence: Synthetic peptide
RIRSKYNNYATYYADAVKD

SEQ ID NO: 17464 - protein, 19 aa, Artificial Sequence
  Description of Artificial Sequence: Synthetic peptide
RIRSKYNNYATYYADAVKD

SEQ ID NO: 17465 - protein, 19 aa, Artificial Sequence
  Description of Artificial Sequence: Synthetic peptide
RIRSKYNNYATYYADSVKD

SEQ ID NO: 17466 - protein, 19 aa, Artificial Sequence
  Description of Artificial Sequence: Synthetic peptide
RIRSKYNNYATYYADAVKD

SEQ ID NO: 17467 - protein, 19 aa, Artificial Sequence
  Description of Artificial Sequence: Synthetic peptide
RIRSKYNNYATYYADAVKD

SEQ ID NO: 17468 - protein, 19 aa, Artificial Sequence
  Description of Artificial Sequence: Synthetic peptide
RIRSKYNNYATYYADSVKD

SEQ ID NO: 17469 - protein, 19 aa, Artificial Sequence
  Description of Artificial Sequence: Synthetic peptide
RIRSKYNNYATYYADAVKD

SEQ ID NO: 17470 - protein, 19 aa, Artificial Sequence
  Description of Artificial Sequence: Synthetic peptide
RIRSKYNNYATYYADAVKD

SEQ ID NO: 17471 - protein, 11 aa, Artificial Sequence
  Description of Artificial Sequence: Synthetic peptide
QVWDYSGQRQV

SEQ ID NO: 17472 - protein, 11 aa, Artificial Sequence
  Description of Artificial Sequence: Synthetic peptide
QVWDYSGQRQV

SEQ ID NO: 17473 - protein, 11 aa, Artificial Sequence
  Description of Artificial Sequence: Synthetic peptide
QVWDYSGQRQV

SEQ ID NO: 17474 - protein, 9 aa, Artificial Sequence
  Description of Artificial Sequence: Synthetic peptide
QQTYSMPFT

SEQ ID NO: 17475 - protein, 9 aa, Artificial Sequence
  Description of Artificial Sequence: Synthetic peptide
QQTYSMPFT

SEQ ID NO: 17476 - protein, 9 aa, Artificial Sequence
  Description of Artificial Sequence: Synthetic peptide
QQTYSMPFT

SEQ ID NO: 17477 - protein, 11 aa, Artificial Sequence
  Description of Artificial Sequence: Synthetic peptide
QVWDYSPLRHV

SEQ ID NO: 17478 - protein, 11 aa, Artificial Sequence
  Description of Artificial Sequence: Synthetic peptide
QVWDYSPLRHV

SEQ ID NO: 17479 - protein, 11 aa, Artificial Sequence
  Description of Artificial Sequence: Synthetic peptide
QVWDYSPLRHV

SEQ ID NO: 17480 - protein, 10 aa, Artificial Sequence
  Description of Artificial Sequence: Synthetic peptide
GKGVHLGFDY

SEQ ID NO: 17481 - protein, 10 aa, Artificial Sequence
  Description of Artificial Sequence: Synthetic peptide
GKGVHLGFDY

SEQ ID NO: 17482 - protein, 10 aa, Artificial Sequence
  Description of Artificial Sequence: Synthetic peptide
GKGVHLGFDY

SEQ ID NO: 17483 - protein, 16 aa, Artificial Sequence
  Description of Artificial Sequence: Synthetic peptide
PSYSGSYYNYFSVMDV

SEQ ID NO: 17484 - protein, 16 aa, Artificial Sequence
  Description of Artificial Sequence: Synthetic peptide
PSYSGSYYNYFSVMDV

SEQ ID NO: 17485 - protein, 16 aa, Artificial Sequence
  Description of Artificial Sequence: Synthetic peptide
PSYSGSYYNYFSVMDV

SEQ ID NO: 17486 - protein, 10 aa, Artificial Sequence
  Description of Artificial Sequence: Synthetic peptide
GKGVHLGFDY

SEQ ID NO: 17487 - protein, 10 aa, Artificial Sequence
  Description of Artificial Sequence: Synthetic peptide
GKGVHLGFDY

SEQ ID NO: 17488 - protein, 10 aa, Artificial Sequence
  Description of Artificial Sequence: Synthetic peptide
GKGVHLGFDY

SEQ ID NO: 17489 - protein, 9 aa, Artificial Sequence
  Description of Artificial Sequence: Synthetic peptide
VLWYSNRWV

SEQ ID NO: 17490 - protein, 9 aa, Artificial Sequence
  Description of Artificial Sequence: Synthetic peptide
VLWYSNRWV

SEQ ID NO: 17491 - protein, 9 aa, Artificial Sequence
  Description of Artificial Sequence: Synthetic peptide
VLWYSNRWV

SEQ ID NO: 17492 - protein, 9 aa, Artificial Sequence
  Description of Artificial Sequence: Synthetic peptide
VLWYSNRWV

SEQ ID NO: 17493 - protein, 9 aa, Artificial Sequence
  Description of Artificial Sequence: Synthetic peptide
VLWYSNRWV

SEQ ID NO: 17494 - protein, 9 aa, Artificial Sequence
  Description of Artificial Sequence: Synthetic peptide
VLWYSNRWV

SEQ ID NO: 17495 - protein, 9 aa, Artificial Sequence
  Description of Artificial Sequence: Synthetic peptide
VLWYSNRWV

SEQ ID NO: 17496 - protein, 9 aa, Artificial Sequence
  Description of Artificial Sequence: Synthetic peptide
VLWYSNRWV

SEQ ID NO: 17497 - protein, 9 aa, Artificial Sequence
  Description of Artificial Sequence: Synthetic peptide
VLWYSNRWV

SEQ ID NO: 17498 - protein, 14 aa, Artificial Sequence
  Description of Artificial Sequence: Synthetic peptide
HGNFGNSYISYWAY

SEQ ID NO: 17499 - protein, 14 aa, Artificial Sequence
  Description of Artificial Sequence: Synthetic peptide
AGNFGSSYISYWAY

SEQ ID NO: 17500 - protein, 14 aa, Artificial Sequence
  Description of Artificial Sequence: Synthetic peptide
AGNFGSSYISYWAY

SEQ ID NO: 17501 - protein, 14 aa, Artificial Sequence
  Description of Artificial Sequence: Synthetic peptide
HGNFGNSYISYWAY

SEQ ID NO: 17502 - protein, 14 aa, Artificial Sequence
  Description of Artificial Sequence: Synthetic peptide
AGNFGSSYISYWAY

SEQ ID NO: 17503 - protein, 14 aa, Artificial Sequence
  Description of Artificial Sequence: Synthetic peptide
AGNFGSSYISYWAY

SEQ ID NO: 17504 - protein, 14 aa, Artificial Sequence
  Description of Artificial Sequence: Synthetic peptide
HGNFGNSYISYWAY

SEQ ID NO: 17505 - protein, 14 aa, Artificial Sequence
  Description of Artificial Sequence: Synthetic peptide
AGNFGSSYISYWAY

SEQ ID NO: 17506 - protein, 14 aa, Artificial Sequence
  Description of Artificial Sequence: Synthetic peptide
AGNFGSSYISYWAY

SEQ ID NO: 17507 - protein, 108 aa, Artificial Sequence; identical to SEQ ID NO: 576
  Description of Artificial Sequence: Synthetic polypeptide

SEQ ID NO: 17508 - protein, 108 aa, Artificial Sequence; identical to SEQ ID NO: 576
  Description of Artificial Sequence: Synthetic polypeptide

SEQ ID NO: 17509 - protein, 108 aa, Artificial Sequence; identical to SEQ ID NO: 576
  Description of Artificial Sequence: Synthetic polypeptide

SEQ ID NO: 17510 - protein, 107 aa, Artificial Sequence; identical to SEQ ID NO: 628
  Description of Artificial Sequence: Synthetic polypeptide

SEQ ID NO: 17511 - protein, 107 aa, Artificial Sequence; identical to SEQ ID NO: 628
  Description of Artificial Sequence: Synthetic polypeptide

SEQ ID NO: 17512 - protein, 107 aa, Artificial Sequence; identical to SEQ ID NO: 628
  Description of Artificial Sequence: Synthetic polypeptide

SEQ ID NO: 17513 - protein, 108 aa, Artificial Sequence; identical to SEQ ID NO: 684
  Description of Artificial Sequence: Synthetic polypeptide

SEQ ID NO: 17514 - protein, 108 aa, Artificial Sequence; identical to SEQ ID NO: 684
  Description of Artificial Sequence: Synthetic polypeptide

SEQ ID NO: 17515 - protein, 108 aa, Artificial Sequence; identical to SEQ ID NO: 684
  Description of Artificial Sequence: Synthetic polypeptide

SEQ ID NO: 17516 - protein, 119 aa, Artificial Sequence; identical to SEQ ID NO: 577
  Description of Artificial Sequence: Synthetic polypeptide

SEQ ID NO: 17517 - protein, 119 aa, Artificial Sequence; identical to SEQ ID NO: 577
  Description of Artificial Sequence: Synthetic polypeptide

SEQ ID NO: 17518 - protein, 119 aa, Artificial Sequence; identical to SEQ ID NO: 577
  Description of Artificial Sequence: Synthetic polypeptide

SEQ ID NO: 17519 - protein, 127 aa, Artificial Sequence; identical to SEQ ID NO: 629
  Description of Artificial Sequence: Synthetic polypeptide

SEQ ID NO: 17520 - protein, 127 aa, Artificial Sequence; identical to SEQ ID NO: 629
  Description of Artificial Sequence: Synthetic polypeptide

SEQ ID NO: 17521 - protein, 127 aa, Artificial Sequence; identical to SEQ ID NO: 629
  Description of Artificial Sequence: Synthetic polypeptide

SEQ ID NO: 17522 - protein, 119 aa, Artificial Sequence; identical to SEQ ID NO: 685
  Description of Artificial Sequence: Synthetic polypeptide

SEQ ID NO: 17523 - protein, 119 aa, Artificial Sequence; identical to SEQ ID NO: 685
  Description of Artificial Sequence: Synthetic polypeptide

SEQ ID NO: 17524 - protein, 119 aa, Artificial Sequence; identical to SEQ ID NO: 685
  Description of Artificial Sequence: Synthetic polypeptide

SEQ ID NO: 17525 - protein, 109 aa, Artificial Sequence; identical to SEQ ID NO: 31
  Description of Artificial Sequence: Synthetic polypeptide

SEQ ID NO: 17526 - protein, 109 aa, Artificial Sequence; identical to SEQ ID NO: 17230
  Description of Artificial Sequence: Synthetic polypeptide

SEQ ID NO: 17527 - protein, 109 aa, Artificial Sequence; identical to SEQ ID NO: 17230
  Description of Artificial Sequence: Synthetic polypeptide

SEQ ID NO: 17528 - protein, 109 aa, Artificial Sequence; identical to SEQ ID NO: 31
  Description of Artificial Sequence: Synthetic polypeptide

SEQ ID NO: 17529 - protein, 109 aa, Artificial Sequence; identical to SEQ ID NO: 17230
  Description of Artificial Sequence: Synthetic polypeptide

SEQ ID NO: 17530 - protein, 109 aa, Artificial Sequence; identical to SEQ ID NO: 17230
  Description of Artificial Sequence: Synthetic polypeptide

SEQ ID NO: 17531 - protein, 109 aa, Artificial Sequence; identical to SEQ ID NO: 31
  Description of Artificial Sequence: Synthetic polypeptide

SEQ ID NO: 17532 - protein, 109 aa, Artificial Sequence; identical to SEQ ID NO: 17230
  Description of Artificial Sequence: Synthetic polypeptide

SEQ ID NO: 17533 - protein, 109 aa, Artificial Sequence; identical to SEQ ID NO: 17230
  Description of Artificial Sequence: Synthetic polypeptide

SEQ ID NO: 17534 - protein, 125 aa, Artificial Sequence; identical to SEQ ID NO: 697
  Description of Artificial Sequence: Synthetic polypeptide

SEQ ID NO: 17535 - protein, 125 aa, Artificial Sequence; identical to SEQ ID NO: 17231
  Description of Artificial Sequence: Synthetic polypeptide

SEQ ID NO: 17536 - protein, 125 aa, Artificial Sequence; identical to SEQ ID NO: 17231
  Description of Artificial Sequence: Synthetic polypeptide

SEQ ID NO: 17537 - protein, 125 aa, Artificial Sequence; identical to SEQ ID NO: 697
  Description of Artificial Sequence: Synthetic polypeptide

SEQ ID NO: 17538 - protein, 125 aa, Artificial Sequence; identical to SEQ ID NO: 17231
  Description of Artificial Sequence: Synthetic polypeptide

SEQ ID NO: 17539 - protein, 125 aa, Artificial Sequence; identical to SEQ ID NO: 17231
  Description of Artificial Sequence: Synthetic polypeptide

SEQ ID NO: 17540 - protein, 125 aa, Artificial Sequence; identical to SEQ ID NO: 697
  Description of Artificial Sequence: Synthetic polypeptide

SEQ ID NO: 17541 - protein, 125 aa, Artificial Sequence; identical to SEQ ID NO: 17231
  Description of Artificial Sequence: Synthetic polypeptide

SEQ ID NO: 17542 - protein, 125 aa, Artificial Sequence; identical to SEQ ID NO: 17231
  Description of Artificial Sequence: Synthetic polypeptide

SEQ ID NO: 17543 - protein, 23 aa, Artificial Sequence
  Description of Artificial Sequence: Synthetic peptide
DIQMTQSPSSLSASVGDRVTITC

SEQ ID NO: 17544 - protein, 23 aa, Artificial Sequence
  Description of Artificial Sequence: Synthetic peptide
DIQMTQSPSSLSASVGDRVTITC

SEQ ID NO: 17545 - protein, 23 aa, Artificial Sequence
  Description of Artificial Sequence: Synthetic peptide
DIQMTQSPSSLSASVGDRVTITC

SEQ ID NO: 17546 - protein, 23 aa, Artificial Sequence
  Description of Artificial Sequence: Synthetic peptide
DIQMTQSPSSLSASVGDRVTITC

SEQ ID NO: 17547 - protein, 22 aa, Artificial Sequence
  Description of Artificial Sequence: Synthetic peptide
SYVLTQPPSVSVAPGKTARITC

SEQ ID NO: 17548 - protein, 22 aa, Artificial Sequence
  Description of Artificial Sequence: Synthetic peptide
SYVLTQPPSVSVAPGQTARITC

SEQ ID NO: 17549 - protein, 22 aa, Artificial Sequence
  Description of Artificial Sequence: Synthetic peptide
SYVLTQPPSVSVAPGQTARITC

SEQ ID NO: 17550 - protein, 22 aa, Artificial Sequence
  Description of Artificial Sequence: Synthetic peptide
SYVLTQPPSVSVAPGQTARITC

SEQ ID NO: 17551 - protein, 22 aa, Artificial Sequence
  Description of Artificial Sequence: Synthetic peptide
SYVLTQPPSVSVAPGQTARITC

SEQ ID NO: 17552 - protein, 22 aa, Artificial Sequence
  Description of Artificial Sequence: Synthetic peptide
SYVLTQPPSVSVAPGQTARITC

SEQ ID NO: 17553 - protein, 22 aa, Artificial Sequence
  Description of Artificial Sequence: Synthetic peptide
SYVLTQPPSVSVAPGQTARITC

SEQ ID NO: 17554 - protein, 22 aa, Artificial Sequence
  Description of Artificial Sequence: Synthetic peptide
QTVVTQEPSLTVSPGGTVTLTC

SEQ ID NO: 17555 - protein, 22 aa, Artificial Sequence
  Description of Artificial Sequence: Synthetic peptide
QTVVTQEPSLTVSPGGTVTLTC

SEQ ID NO: 17556 - protein, 22 aa, Artificial Sequence
  Description of Artificial Sequence: Synthetic peptide
QTVVTQEPSLTVSPGGTVTITC

SEQ ID NO: 17557 - protein, 22 aa, Artificial Sequence
  Description of Artificial Sequence: Synthetic peptide
QTVVTQEPSLTVSPGGTVTITC

SEQ ID NO: 17558 - protein, 22 aa, Artificial Sequence
  Description of Artificial Sequence: Synthetic peptide
QTVVTQEPSLTVSPGGTVTLTC

SEQ ID NO: 17559 - protein, 22 aa, Artificial Sequence
  Description of Artificial Sequence: Synthetic peptide
QTVVTQEPSLTVSPGGTVTITC

SEQ ID NO: 17560 - protein, 22 aa, Artificial Sequence
  Description of Artificial Sequence: Synthetic peptide
QTVVTQEPSLTVSPGGTVTITC

SEQ ID NO: 17561 - protein, 22 aa, Artificial Sequence
  Description of Artificial Sequence: Synthetic peptide
QTVVTQEPSLTVSPGGTVTLTC

SEQ ID NO: 17562 - protein, 22 aa, Artificial Sequence
  Description of Artificial Sequence: Synthetic peptide
QTVVTQEPSLTVSPGGTVTITC

SEQ ID NO: 17563 - protein, 22 aa, Artificial Sequence
  Description of Artificial Sequence: Synthetic peptide
QTVVTQEPSLTVSPGGTVTITC

SEQ ID NO: 17564 - protein, 30 aa, Artificial Sequence; identical to SEQ ID NO: 779
  Description of Artificial Sequence: Synthetic polypeptide

SEQ ID NO: 17565 - protein, 30 aa, Artificial Sequence; identical to SEQ ID NO: 779
  Description of Artificial Sequence: Synthetic polypeptide

SEQ ID NO: 17566 - protein, 30 aa, Artificial Sequence; identical to SEQ ID NO: 779
  Description of Artificial Sequence: Synthetic polypeptide

SEQ ID NO: 17567 - protein, 30 aa, Artificial Sequence; identical to SEQ ID NO: 779
  Description of Artificial Sequence: Synthetic polypeptide

SEQ ID NO: 17568 - protein, 30 aa, Artificial Sequence; identical to SEQ ID NO: 779
  Description of Artificial Sequence: Synthetic polypeptide

SEQ ID NO: 17569 - protein, 30 aa, Artificial Sequence; identical to SEQ ID NO: 779
  Description of Artificial Sequence: Synthetic polypeptide

SEQ ID NO: 17570 - protein, 30 aa, Artificial Sequence; identical to SEQ ID NO: 779
  Description of Artificial Sequence: Synthetic polypeptide

SEQ ID NO: 17571 - protein, 30 aa, Artificial Sequence; identical to SEQ ID NO: 793
  Description of Artificial Sequence: Synthetic polypeptide

SEQ ID NO: 17572 - protein, 30 aa, Artificial Sequence; identical to SEQ ID NO: 794
  Description of Artificial Sequence: Synthetic polypeptide

SEQ ID NO: 17573 - protein, 30 aa, Artificial Sequence; identical to SEQ ID NO: 794
  Description of Artificial Sequence: Synthetic polypeptide

SEQ ID NO: 17574 - protein, 30 aa, Artificial Sequence; identical to SEQ ID NO: 794
  Description of Artificial Sequence: Synthetic polypeptide

SEQ ID NO: 17575 - protein, 30 aa, Artificial Sequence; identical to SEQ ID NO: 793
  Description of Artificial Sequence: Synthetic polypeptide

SEQ ID NO: 17576 - protein, 30 aa, Artificial Sequence; identical to SEQ ID NO: 794
  Description of Artificial Sequence: Synthetic polypeptide

SEQ ID NO: 17577 - protein, 30 aa, Artificial Sequence; identical to SEQ ID NO: 794
  Description of Artificial Sequence: Synthetic polypeptide

SEQ ID NO: 17578 - protein, 30 aa, Artificial Sequence; identical to SEQ ID NO: 794
  Description of Artificial Sequence: Synthetic polypeptide

SEQ ID NO: 17579 - protein, 30 aa, Artificial Sequence; identical to SEQ ID NO: 794
  Description of Artificial Sequence: Synthetic polypeptide

SEQ ID NO: 17580 - protein, 30 aa, Artificial Sequence; identical to SEQ ID NO: 794
  Description of Artificial Sequence: Synthetic polypeptide

SEQ ID NO: 17581 - protein, 30 aa, Artificial Sequence; identical to SEQ ID NO: 794
  Description of Artificial Sequence: Synthetic polypeptide

SEQ ID NO: 17582 - protein, 30 aa, Artificial Sequence; identical to SEQ ID NO: 832
  Description of Artificial Sequence: Synthetic polypeptide

SEQ ID NO: 17583 - protein, 30 aa, Artificial Sequence; identical to SEQ ID NO: 833
  Description of Artificial Sequence: Synthetic polypeptide

SEQ ID NO: 17584 - protein, 30 aa, Artificial Sequence; identical to SEQ ID NO: 833
  Description of Artificial Sequence: Synthetic polypeptide

SEQ ID NO: 17585 - protein, 30 aa, Artificial Sequence; identical to SEQ ID NO: 833
  Description of Artificial Sequence: Synthetic polypeptide

SEQ ID NO: 17586 - protein, 11 aa, Artificial Sequence
  Description of Artificial Sequence: Synthetic peptide
RASQSISSYLN

SEQ ID NO: 17587 - protein, 11 aa, Artificial Sequence
  Description of Artificial Sequence: Synthetic peptide
RTSQSISSYLN

SEQ ID NO: 17588 - protein, 11 aa, Artificial Sequence
  Description of Artificial Sequence: Synthetic peptide
RTSQSISSYLN

SEQ ID NO: 17589 - protein, 11 aa, Artificial Sequence
  Description of Artificial Sequence: Synthetic peptide
RTSQSISSYLN

SEQ ID NO: 17590 - protein, 11 aa, Artificial Sequence
  Description of Artificial Sequence: Synthetic peptide
GGNNIGSKSVH

SEQ ID NO: 17591 - protein, 11 aa, Artificial Sequence
  Description of Artificial Sequence: Synthetic peptide
GGNNIGSKSVH

SEQ ID NO: 17592 - protein, 11 aa, Artificial Sequence
  Description of Artificial Sequence: Synthetic peptide
GGNNIGSKSVH

SEQ ID NO: 17593 - protein, 11 aa, Artificial Sequence
  Description of Artificial Sequence: Synthetic peptide
GGNNIGSKSVH

SEQ ID NO: 17594 - protein, 11 aa, Artificial Sequence
  Description of Artificial Sequence: Synthetic peptide
GGNNIGSKSVH

SEQ ID NO: 17595 - protein, 11 aa, Artificial Sequence
  Description of Artificial Sequence: Synthetic peptide
GGNNIGSKSVH

SEQ ID NO: 17596 - protein, 11 aa, Artificial Sequence
  Description of Artificial Sequence: Synthetic peptide
GGNNIGSKSVH

SEQ ID NO: 17597 - protein, 14 aa, Artificial Sequence
  Description of Artificial Sequence: Synthetic peptide
ASSTGAVTSGYYPN

SEQ ID NO: 17598 - protein, 14 aa, Artificial Sequence
  Description of Artificial Sequence: Synthetic peptide
GSSTGAVTSGNYPN

SEQ ID NO: 17599 - protein, 14 aa, Artificial Sequence
  Description of Artificial Sequence: Synthetic peptide
GSSTGAVTSGNYPN

SEQ ID NO: 17600 - protein, 14 aa, Artificial Sequence
  Description of Artificial Sequence: Synthetic peptide
GSSTGAVTSGNYPN

SEQ ID NO: 17601 - protein, 14 aa, Artificial Sequence
  Description of Artificial Sequence: Synthetic peptide
GSSTGAVTSGNYPN

SEQ ID NO: 17602 - protein, 14 aa, Artificial Sequence
  Description of Artificial Sequence: Synthetic peptide
GSSTGAVTSGNYPN

SEQ ID NO: 17603 - protein, 14 aa, Artificial Sequence
  Description of Artificial Sequence: Synthetic peptide
GSSTGAVTSGNYPN

SEQ ID NO: 17604 - protein, 14 aa, Artificial Sequence
  Description of Artificial Sequence: Synthetic peptide
GSSTGAVTSGNYPN

SEQ ID NO: 17605 - protein, 14 aa, Artificial Sequence
  Description of Artificial Sequence: Synthetic peptide
GSSTGAVTSGNYPN

SEQ ID NO: 17606 - protein, 14 aa, Artificial Sequence
  Description of Artificial Sequence: Synthetic peptide
GSSTGAVTSGNYPN

SEQ ID NO: 17607 - protein, 5 aa, Artificial Sequence
  Description of Artificial Sequence: Synthetic peptide
SYAMS

SEQ ID NO: 17608 - protein, 5 aa, Artificial Sequence
  Description of Artificial Sequence: Synthetic peptide
SYAMS

SEQ ID NO: 17609 - protein, 5 aa, Artificial Sequence
  Description of Artificial Sequence: Synthetic peptide
SYAMS

SEQ ID NO: 17610 - protein, 5 aa, Artificial Sequence
  Description of Artificial Sequence: Synthetic peptide
SYAMS

SEQ ID NO: 17611 - protein, 5 aa, Artificial Sequence
  Description of Artificial Sequence: Synthetic peptide
SHAMS

SEQ ID NO: 17612 - protein, 5 aa, Artificial Sequence
  Description of Artificial Sequence: Synthetic peptide
SHAMS

SEQ ID NO: 17613 - protein, 5 aa, Artificial Sequence
  Description of Artificial Sequence: Synthetic peptide
SHAMS

SEQ ID NO: 17614 - protein, 5 aa, Artificial Sequence
  Description of Artificial Sequence: Synthetic peptide
GSAMH

SEQ ID NO: 17615 - protein, 5 aa, Artificial Sequence
  Description of Artificial Sequence: Synthetic peptide
KYAMN

SEQ ID NO: 17616 - protein, 5 aa, Artificial Sequence
  Description of Artificial Sequence: Synthetic peptide
KYAMN

SEQ ID NO: 17617 - protein, 5 aa, Artificial Sequence
  Description of Artificial Sequence: Synthetic peptide
KYAMN

SEQ ID NO: 17618 - protein, 5 aa, Artificial Sequence
  Description of Artificial Sequence: Synthetic peptide
GSAMH

SEQ ID NO: 17619 - protein, 5 aa, Artificial Sequence
  Description of Artificial Sequence: Synthetic peptide
KYAIN

SEQ ID NO: 17620 - protein, 5 aa, Artificial Sequence
  Description of Artificial Sequence: Synthetic peptide
KYAIN

SEQ ID NO: 17621 - protein, 5 aa, Artificial Sequence
  Description of Artificial Sequence: Synthetic peptide
KYAIN

SEQ ID NO: 17622 - protein, 5 aa, Artificial Sequence
  Description of Artificial Sequence: Synthetic peptide
KYAIN

SEQ ID NO: 17623 - protein, 5 aa, Artificial Sequence
  Description of Artificial Sequence: Synthetic peptide
KYAIN

SEQ ID NO: 17624 - protein, 5 aa, Artificial Sequence
  Description of Artificial Sequence: Synthetic peptide
KYAIN

SEQ ID NO: 17625 - protein, 5 aa, Artificial Sequence
  Description of Artificial Sequence: Synthetic peptide
NAWMS

SEQ ID NO: 17626 - protein, 5 aa, Artificial Sequence
  Description of Artificial Sequence: Synthetic peptide
NAWMS

SEQ ID NO: 17627 - protein, 5 aa, Artificial Sequence
  Description of Artificial Sequence: Synthetic peptide
NAWMS

SEQ ID NO: 17628 - protein, 5 aa, Artificial Sequence
  Description of Artificial Sequence: Synthetic peptide
NAWMS

SEQ ID NO: 17629 - protein, 15 aa, Artificial Sequence
  Description of Artificial Sequence: Synthetic peptide
WYQQKPGKAPKLLIY

SEQ ID NO: 17630 - protein, 15 aa, Artificial Sequence
  Description of Artificial Sequence: Synthetic peptide
WYQQKPGRAPKLLIF

SEQ ID NO: 17631 - protein, 15 aa, Artificial Sequence
  Description of Artificial Sequence: Synthetic peptide
WYQQKPGRAPKLLIF

SEQ ID NO: 17632 - protein, 15 aa, Artificial Sequence
  Description of Artificial Sequence: Synthetic peptide
WYQQKPGRAPKLLIF

SEQ ID NO: 17633 - protein, 15 aa, Artificial Sequence
  Description of Artificial Sequence: Synthetic peptide
WYQQKPGQAPVLVIY

SEQ ID NO: 17634 - protein, 15 aa, Artificial Sequence
  Description of Artificial Sequence: Synthetic peptide
WYQQKPGQAPVMVVY

SEQ ID NO: 17635 - protein, 15 aa, Artificial Sequence
  Description of Artificial Sequence: Synthetic peptide
WYQQKPGQAPVMVVY

SEQ ID NO: 17636 - protein, 15 aa, Artificial Sequence
  Description of Artificial Sequence: Synthetic peptide
WYQQKPGQAPVMVVY

SEQ ID NO: 17637 - protein, 15 aa, Artificial Sequence
  Description of Artificial Sequence: Synthetic peptide
WYQQKPGQAPVMVVY

SEQ ID NO: 17638 - protein, 15 aa, Artificial Sequence
  Description of Artificial Sequence: Synthetic peptide
WYQQKPGQAPVMVVY

SEQ ID NO: 17639 - protein, 15 aa, Artificial Sequence
  Description of Artificial Sequence: Synthetic peptide
WYQQKPGQAPVMVVY

SEQ ID NO: 17640 - protein, 15 aa, Artificial Sequence
  Description of Artificial Sequence: Synthetic peptide
WFQQKPGQAPRALIY

SEQ ID NO: 17641 - protein, 15 aa, Artificial Sequence
  Description of Artificial Sequence: Synthetic peptide
WVQQKPGQAPRGLIG

SEQ ID NO: 17642 - protein, 15 aa, Artificial Sequence
  Description of Artificial Sequence: Synthetic peptide
WVQKKPGQAPRGLIG

SEQ ID NO: 17643 - protein, 15 aa, Artificial Sequence
  Description of Artificial Sequence: Synthetic peptide
WVQKKPGQAPRGLIG

SEQ ID NO: 17644 - protein, 15 aa, Artificial Sequence
  Description of Artificial Sequence: Synthetic peptide
WVQQKPGQAPRGLIG

SEQ ID NO: 17645 - protein, 15 aa, Artificial Sequence
  Description of Artificial Sequence: Synthetic peptide
WVQKKPGQAPRGLIG

SEQ ID NO: 17646 - protein, 15 aa, Artificial Sequence
  Description of Artificial Sequence: Synthetic peptide
WVQKKPGQAPRGLIG

SEQ ID NO: 17647 - protein, 15 aa, Artificial Sequence
  Description of Artificial Sequence: Synthetic peptide
WVQQKPGQAPRGLIG

SEQ ID NO: 17648 - protein, 15 aa, Artificial Sequence
  Description of Artificial Sequence: Synthetic peptide
WVQKKPGQAPRGLIG

SEQ ID NO: 17649 - protein, 15 aa, Artificial Sequence
  Description of Artificial Sequence: Synthetic peptide
WVQKKPGQAPRGLIG

SEQ ID NO: 17650 - protein, 14 aa, Artificial Sequence
  Description of Artificial Sequence: Synthetic peptide
WVRQAPGKGLEWVS

SEQ ID NO: 17651 - protein, 14 aa, Artificial Sequence
  Description of Artificial Sequence: Synthetic peptide
WVRQAPGKCLEWVS

SEQ ID NO: 17652 - protein, 14 aa, Artificial Sequence
  Description of Artificial Sequence: Synthetic peptide
WVRQAPGKCLEWVS

SEQ ID NO: 17653 - protein, 14 aa, Artificial Sequence
  Description of Artificial Sequence: Synthetic peptide
WVRQAPGKCLEWVS

SEQ ID NO: 17654 - protein, 14 aa, Artificial Sequence
  Description of Artificial Sequence: Synthetic peptide
WVRQAPGKCLEWVS

SEQ ID NO: 17655 - protein, 14 aa, Artificial Sequence
  Description of Artificial Sequence: Synthetic peptide
WVRQAPGKCLEWVS

SEQ ID NO: 17656 - protein, 14 aa, Artificial Sequence
  Description of Artificial Sequence: Synthetic peptide
WVRQAPGKCLEWVS

SEQ ID NO: 17657 - protein, 14 aa, Artificial Sequence
  Description of Artificial Sequence: Synthetic peptide
WVRQASGKGLEWVG

SEQ ID NO: 17658 - protein, 14 aa, Artificial Sequence
  Description of Artificial Sequence: Synthetic peptide
WVRQAPGKGLEWVA

SEQ ID NO: 17659 - protein, 14 aa, Artificial Sequence
  Description of Artificial Sequence: Synthetic peptide
WVRQAPGKGLEWVA

SEQ ID NO: 17660 - protein, 14 aa, Artificial Sequence
  Description of Artificial Sequence: Synthetic peptide
WVRQAPGKGLEWVA

SEQ ID NO: 17661 - protein, 14 aa, Artificial Sequence
  Description of Artificial Sequence: Synthetic peptide
WVRQASGKGLEWVG

SEQ ID NO: 17662 - protein, 14 aa, Artificial Sequence
  Description of Artificial Sequence: Synthetic peptide
WVRQAPGKGLEWVA

SEQ ID NO: 17663 - protein, 14 aa, Artificial Sequence
  Description of Artificial Sequence: Synthetic peptide
WVRQAPGKGLEWVA

SEQ ID NO: 17664 - protein, 14 aa, Artificial Sequence
  Description of Artificial Sequence: Synthetic peptide
WVRQAPGKGLEWVA

SEQ ID NO: 17665 - protein, 14 aa, Artificial Sequence
  Description of Artificial Sequence: Synthetic peptide
WVRQAPGKGLEWVA

SEQ ID NO: 17666 - protein, 14 aa, Artificial Sequence
  Description of Artificial Sequence: Synthetic peptide
WVRQAPGKGLEWVA

SEQ ID NO: 17667 - protein, 14 aa, Artificial Sequence
  Description of Artificial Sequence: Synthetic peptide
WVRQAPGKGLEWVA

SEQ ID NO: 17668 - protein, 14 aa, Artificial Sequence
  Description of Artificial Sequence: Synthetic peptide
WVRQAPGKGLEWVG

SEQ ID NO: 17669 - protein, 14 aa, Artificial Sequence
  Description of Artificial Sequence: Synthetic peptide
WVRQAPGKCLEWVG

SEQ ID NO: 17670 - protein, 14 aa, Artificial Sequence
  Description of Artificial Sequence: Synthetic peptide
WVRQAPGKCLEWVG

SEQ ID NO: 17671 - protein, 14 aa, Artificial Sequence
  Description of Artificial Sequence: Synthetic peptide
WVRQAPGKCLEWVG

SEQ ID NO: 17672 - protein, 7 aa, Artificial Sequence
  Description of Artificial Sequence: Synthetic peptide
AASSLQS

SEQ ID NO: 17673 - protein, 7 aa, Artificial Sequence
  Description of Artificial Sequence: Synthetic peptide
AASSLQG

SEQ ID NO: 17674 - protein, 7 aa, Artificial Sequence
  Description of Artificial Sequence: Synthetic peptide
AASSLQG

SEQ ID NO: 17675 - protein, 7 aa, Artificial Sequence
  Description of Artificial Sequence: Synthetic peptide
AASSLQG

SEQ ID NO: 17676 - protein, 7 aa, Artificial Sequence
  Description of Artificial Sequence: Synthetic peptide
YDSDRPS

SEQ ID NO: 17677 - protein, 7 aa, Artificial Sequence
  Description of Artificial Sequence: Synthetic peptide
DDNDRPS

SEQ ID NO: 17678 - protein, 7 aa, Artificial Sequence
  Description of Artificial Sequence: Synthetic peptide
DDNDRPS

SEQ ID NO: 17679 - protein, 7 aa, Artificial Sequence
  Description of Artificial Sequence: Synthetic peptide
DDNDRPS

SEQ ID NO: 17680 - protein, 7 aa, Artificial Sequence
  Description of Artificial Sequence: Synthetic peptide
DDNDRPS

SEQ ID NO: 17681 - protein, 7 aa, Artificial Sequence
  Description of Artificial Sequence: Synthetic peptide
DDNDRPS

SEQ ID NO: 17682 - protein, 7 aa, Artificial Sequence
  Description of Artificial Sequence: Synthetic peptide
DDNDRPS

SEQ ID NO: 17683 - protein, 7 aa, Artificial Sequence
  Description of Artificial Sequence: Synthetic peptide
STSNKHS

SEQ ID NO: 17684 - protein, 7 aa, Artificial Sequence
  Description of Artificial Sequence: Synthetic peptide
GTKFLAP

SEQ ID NO: 17685 - protein, 7 aa, Artificial Sequence
  Description of Artificial Sequence: Synthetic peptide
GTKFLAP

SEQ ID NO: 17686 - protein, 7 aa, Artificial Sequence
  Description of Artificial Sequence: Synthetic peptide
GTKFLAP

SEQ ID NO: 17687 - protein, 7 aa, Artificial Sequence
  Description of Artificial Sequence: Synthetic peptide
GTKFLAP

SEQ ID NO: 17688 - protein, 7 aa, Artificial Sequence
  Description of Artificial Sequence: Synthetic peptide
GTKFLAP

SEQ ID NO: 17689 - protein, 7 aa, Artificial Sequence
  Description of Artificial Sequence: Synthetic peptide
GTKFLAP

SEQ ID NO: 17690 - protein, 7 aa, Artificial Sequence
  Description of Artificial Sequence: Synthetic peptide
GTKFLAP

SEQ ID NO: 17691 - protein, 7 aa, Artificial Sequence
  Description of Artificial Sequence: Synthetic peptide
GTKFLAP

SEQ ID NO: 17692 - protein, 7 aa, Artificial Sequence
  Description of Artificial Sequence: Synthetic peptide
GTKFLAP

SEQ ID NO: 17693 - protein, 17 aa, Artificial Sequence
  Description of Artificial Sequence: Synthetic peptide
AISGSGGSTYYADSVKG

SEQ ID NO: 17694 - protein, 17 aa, Artificial Sequence
  Description of Artificial Sequence: Synthetic peptide
AISGSGGGTYYAASVKG

SEQ ID NO: 17695 - protein, 17 aa, Artificial Sequence
  Description of Artificial Sequence: Synthetic peptide
AISGSGGGTYYAASVKG

SEQ ID NO: 17696 - protein, 17 aa, Artificial Sequence
  Description of Artificial Sequence: Synthetic peptide
AISGSGGGTYYAASVKG

SEQ ID NO: 17697 - protein, 17 aa, Artificial Sequence
  Description of Artificial Sequence: Synthetic peptide
SISGSGGGTYYAASVKG

SEQ ID NO: 17698 - protein, 17 aa, Artificial Sequence
  Description of Artificial Sequence: Synthetic peptide
SISGSGGGTYYAASVKG

SEQ ID NO: 17699 - protein, 17 aa, Artificial Sequence
  Description of Artificial Sequence: Synthetic peptide
SISGSGGGTYYAASVKG

SEQ ID NO: 17700 - protein, 19 aa, Artificial Sequence
  Description of Artificial Sequence: Synthetic peptide
RIRSKANSYATAYAASVKG

SEQ ID NO: 17701 - protein, 19 aa, Artificial Sequence
  Description of Artificial Sequence: Synthetic peptide
RIRSKYNNYATYYADSVKD

SEQ ID NO: 17702 - protein, 19 aa, Artificial Sequence
  Description of Artificial Sequence: Synthetic peptide
RIRSKYNNYATYYADSVKD

SEQ ID NO: 17703 - protein, 19 aa, Artificial Sequence
  Description of Artificial Sequence: Synthetic peptide
RIRSKYNNYATYYADSVKD

SEQ ID NO: 17704 - protein, 19 aa, Artificial Sequence
  Description of Artificial Sequence: Synthetic peptide
RIRSKANSYATAYAASVKG

SEQ ID NO: 17705 - protein, 19 aa, Artificial Sequence
  Description of Artificial Sequence: Synthetic peptide
RIRSKYNNYATYYADAVKD

SEQ ID NO: 17706 - protein, 19 aa, Artificial Sequence
  Description of Artificial Sequence: Synthetic peptide
RIRSKYNNYATYYADAVKD

SEQ ID NO: 17707 - protein, 19 aa, Artificial Sequence
  Description of Artificial Sequence: Synthetic peptide
RIRSKYNNYATYYADAVKD

SEQ ID NO: 17708 - protein, 19 aa, Artificial Sequence
  Description of Artificial Sequence: Synthetic peptide
RIRSKYNNYATYYADAVKD

SEQ ID NO: 17709 - protein, 19 aa, Artificial Sequence
  Description of Artificial Sequence: Synthetic peptide
RIRSKYNNYATYYADAVKD

SEQ ID NO: 17710 - protein, 19 aa, Artificial Sequence
  Description of Artificial Sequence: Synthetic peptide
RIRSKYNNYATYYADAVKD

SEQ ID NO: 17711 - protein, 19 aa, Artificial Sequence
  Description of Artificial Sequence: Synthetic peptide
RIKSKTDGGTTDYAAPVKG

SEQ ID NO: 17712 - protein, 19 aa, Artificial Sequence
  Description of Artificial Sequence: Synthetic peptide
RIRSRSYGGTTDYAAPVKG

SEQ ID NO: 17713 - protein, 19 aa, Artificial Sequence
  Description of Artificial Sequence: Synthetic peptide
RIRSRSYGGTTDYAAPVKG

SEQ ID NO: 17714 - protein, 19 aa, Artificial Sequence
  Description of Artificial Sequence: Synthetic peptide
RIRSRSYGGTTDYAAPVKG

SEQ ID NO: 17715 - protein, 32 aa, Artificial Sequence; identical to SEQ ID NO: 1346
  Description of Artificial Sequence: Synthetic polypeptide

SEQ ID NO: 17716 - protein, 32 aa, Artificial Sequence; identical to SEQ ID NO: 1346
  Description of Artificial Sequence: Synthetic polypeptide

SEQ ID NO: 17717 - protein, 32 aa, Artificial Sequence; identical to SEQ ID NO: 1346
  Description of Artificial Sequence: Synthetic polypeptide

SEQ ID NO: 17718 - protein, 32 aa, Artificial Sequence; identical to SEQ ID NO: 1346
  Description of Artificial Sequence: Synthetic polypeptide

SEQ ID NO: 17719 - protein, 32 aa, Artificial Sequence; identical to SEQ ID NO: 1374
  Description of Artificial Sequence: Synthetic polypeptide

SEQ ID NO: 17720 - protein, 32 aa, Artificial Sequence; identical to SEQ ID NO: 1374
  Description of Artificial Sequence: Synthetic polypeptide

SEQ ID NO: 17721 - protein, 32 aa, Artificial Sequence; identical to SEQ ID NO: 1374
  Description of Artificial Sequence: Synthetic polypeptide

SEQ ID NO: 17722 - protein, 32 aa, Artificial Sequence; identical to SEQ ID NO: 1374
  Description of Artificial Sequence: Synthetic polypeptide

SEQ ID NO: 17723 - protein, 32 aa, Artificial Sequence; identical to SEQ ID NO: 1374
  Description of Artificial Sequence: Synthetic polypeptide

SEQ ID NO: 17724 - protein, 32 aa, Artificial Sequence; identical to SEQ ID NO: 1374
  Description of Artificial Sequence: Synthetic polypeptide

SEQ ID NO: 17725 - protein, 32 aa, Artificial Sequence; identical to SEQ ID NO: 1374
  Description of Artificial Sequence: Synthetic polypeptide

SEQ ID NO: 17726 - protein, 32 aa, Artificial Sequence; identical to SEQ ID NO: 1385
  Description of Artificial Sequence: Synthetic polypeptide

SEQ ID NO: 17727 - protein, 32 aa, Artificial Sequence; identical to SEQ ID NO: 1386
  Description of Artificial Sequence: Synthetic polypeptide

SEQ ID NO: 17728 - protein, 32 aa, Artificial Sequence; identical to SEQ ID NO: 17249
  Description of Artificial Sequence: Synthetic polypeptide

SEQ ID NO: 17729 - protein, 32 aa, Artificial Sequence; identical to SEQ ID NO: 17249
  Description of Artificial Sequence: Synthetic polypeptide

SEQ ID NO: 17730 - protein, 32 aa, Artificial Sequence; identical to SEQ ID NO: 1386
  Description of Artificial Sequence: Synthetic polypeptide

SEQ ID NO: 17731 - protein, 32 aa, Artificial Sequence; identical to SEQ ID NO: 17249
  Description of Artificial Sequence: Synthetic polypeptide

SEQ ID NO: 17732 - protein, 32 aa, Artificial Sequence; identical to SEQ ID NO: 17249
  Description of Artificial Sequence: Synthetic polypeptide

SEQ ID NO: 17733 - protein, 32 aa, Artificial Sequence; identical to SEQ ID NO: 1386
  Description of Artificial Sequence: Synthetic polypeptide

SEQ ID NO: 17734 - protein, 32 aa, Artificial Sequence; identical to SEQ ID NO: 17249
  Description of Artificial Sequence: Synthetic polypeptide

SEQ ID NO: 17735 - protein, 32 aa, Artificial Sequence; identical to SEQ ID NO: 17249
  Description of Artificial Sequence: Synthetic polypeptide

SEQ ID NO: 17736 - protein, 32 aa, Artificial Sequence; identical to SEQ ID NO: 1427
  Description of Artificial Sequence: Synthetic polypeptide

SEQ ID NO: 17737 - protein, 32 aa, Artificial Sequence; identical to SEQ ID NO: 1434
  Description of Artificial Sequence: Synthetic polypeptide

SEQ ID NO: 17738 - protein, 32 aa, Artificial Sequence; identical to SEQ ID NO: 1434
  Description of Artificial Sequence: Synthetic polypeptide

SEQ ID NO: 17739 - protein, 32 aa, Artificial Sequence; identical to SEQ ID NO: 1434
  Description of Artificial Sequence: Synthetic polypeptide

SEQ ID NO: 17740 - protein, 32 aa, Artificial Sequence; identical to SEQ ID NO: 1428
  Description of Artificial Sequence: Synthetic polypeptide

SEQ ID NO: 17741 - protein, 32 aa, Artificial Sequence; identical to SEQ ID NO: 1428
  Description of Artificial Sequence: Synthetic polypeptide

SEQ ID NO: 17742 - protein, 32 aa, Artificial Sequence; identical to SEQ ID NO: 1428
  Description of Artificial Sequence: Synthetic polypeptide

SEQ ID NO: 17743 - protein, 32 aa, Artificial Sequence; identical to SEQ ID NO: 1441
  Description of Artificial Sequence: Synthetic polypeptide

SEQ ID NO: 17744 - protein, 32 aa, Artificial Sequence; identical to SEQ ID NO: 1442
  Description of Artificial Sequence: Synthetic polypeptide

SEQ ID NO: 17745 - protein, 32 aa, Artificial Sequence; identical to SEQ ID NO: 1442
  Description of Artificial Sequence: Synthetic polypeptide

SEQ ID NO: 17746 - protein, 32 aa, Artificial Sequence; identical to SEQ ID NO: 1442
  Description of Artificial Sequence: Synthetic polypeptide

SEQ ID NO: 17747 - protein, 32 aa, Artificial Sequence; identical to SEQ ID NO: 1441
  Description of Artificial Sequence: Synthetic polypeptide

SEQ ID NO: 17748 - protein, 32 aa, Artificial Sequence; identical to SEQ ID NO: 17251
  Description of Artificial Sequence: Synthetic polypeptide

SEQ ID NO: 17749 - protein, 32 aa, Artificial Sequence; identical to SEQ ID NO: 17251
  Description of Artificial Sequence: Synthetic polypeptide

SEQ ID NO: 17750 - protein, 32 aa, Artificial Sequence; identical to SEQ ID NO: 17251
  Description of Artificial Sequence: Synthetic polypeptide

SEQ ID NO: 17751 - protein, 32 aa, Artificial Sequence; identical to SEQ ID NO: 17251
  Description of Artificial Sequence: Synthetic polypeptide

SEQ ID NO: 17752 - protein, 32 aa, Artificial Sequence; identical to SEQ ID NO: 17251
  Description of Artificial Sequence: Synthetic polypeptide

SEQ ID NO: 17753 - protein, 32 aa, Artificial Sequence; identical to SEQ ID NO: 17251
  Description of Artificial Sequence: Synthetic polypeptide

SEQ ID NO: 17754 - protein, 32 aa, Artificial Sequence; identical to SEQ ID NO: 1480
  Description of Artificial Sequence: Synthetic polypeptide

SEQ ID NO: 17755 - protein, 32 aa, Artificial Sequence; identical to SEQ ID NO: 1481
  Description of Artificial Sequence: Synthetic polypeptide

SEQ ID NO: 17756 - protein, 32 aa, Artificial Sequence; identical to SEQ ID NO: 1481
  Description of Artificial Sequence: Synthetic polypeptide

SEQ ID NO: 17757 - protein, 32 aa, Artificial Sequence; identical to SEQ ID NO: 1481
  Description of Artificial Sequence: Synthetic polypeptide

SEQ ID NO: 17758 - protein, 9 aa, Artificial Sequence
  Description of Artificial Sequence: Synthetic peptide
QQSYSTPWT

SEQ ID NO: 17759 - protein, 9 aa, Artificial Sequence
  Description of Artificial Sequence: Synthetic peptide
QQTYSMPFT

SEQ ID NO: 17760 - protein, 9 aa, Artificial Sequence
  Description of Artificial Sequence: Synthetic peptide
QQTYSMPFT

SEQ ID NO: 17761 - protein, 9 aa, Artificial Sequence
  Description of Artificial Sequence: Synthetic peptide
QQTYSMPFT

SEQ ID NO: 17762 - protein, 11 aa, Artificial Sequence
  Description of Artificial Sequence: Synthetic peptide
QVWDSSSDHVV

SEQ ID NO: 17763 - protein, 11 aa, Artificial Sequence
  Description of Artificial Sequence: Synthetic peptide
QVWDYSGQRQV

SEQ ID NO: 17764 - protein, 11 aa, Artificial Sequence
  Description of Artificial Sequence: Synthetic peptide
QVWDYSGQRQV

SEQ ID NO: 17765 - protein, 11 aa, Artificial Sequence
  Description of Artificial Sequence: Synthetic peptide
QVWDYSGQRQV

SEQ ID NO: 17766 - protein, 11 aa, Artificial Sequence
  Description of Artificial Sequence: Synthetic peptide
QVWDYSPLRHV

SEQ ID NO: 17767 - protein, 11 aa, Artificial Sequence
  Description of Artificial Sequence: Synthetic peptide
QVWDYSPLRHV

SEQ ID NO: 17768 - protein, 11 aa, Artificial Sequence
  Description of Artificial Sequence: Synthetic peptide
QVWDYSPLRHV

SEQ ID NO: 17769 - protein, 10 aa, Artificial Sequence
  Description of Artificial Sequence: Synthetic peptide
LLYYGGAQWV

SEQ ID NO: 17770 - protein, 9 aa, Artificial Sequence
  Description of Artificial Sequence: Synthetic peptide
VLWYSNRWV

SEQ ID NO: 17771 - protein, 9 aa, Artificial Sequence
  Description of Artificial Sequence: Synthetic peptide
VLWYSNRWV

SEQ ID NO: 17772 - protein, 9 aa, Artificial Sequence
  Description of Artificial Sequence: Synthetic peptide
VLWYSNRWV

SEQ ID NO: 17773 - protein, 9 aa, Artificial Sequence
  Description of Artificial Sequence: Synthetic peptide
VLWYSNRWV

SEQ ID NO: 17774 - protein, 9 aa, Artificial Sequence
  Description of Artificial Sequence: Synthetic peptide
VLWYSNRWV

SEQ ID NO: 17775 - protein, 9 aa, Artificial Sequence
  Description of Artificial Sequence: Synthetic peptide
VLWYSNRWV

SEQ ID NO: 17776 - protein, 9 aa, Artificial Sequence
  Description of Artificial Sequence: Synthetic peptide
VLWYSNRWV

SEQ ID NO: 17777 - protein, 9 aa, Artificial Sequence
  Description of Artificial Sequence: Synthetic peptide
VLWYSNRWV

SEQ ID NO: 17778 - protein, 9 aa, Artificial Sequence
  Description of Artificial Sequence: Synthetic peptide
VLWYSNRWV

SEQ ID NO: 17779 - protein, 10 aa, Artificial Sequence
  Description of Artificial Sequence: Synthetic peptide
GIAVAGYFDY

SEQ ID NO: 17780 - protein, 10 aa, Artificial Sequence
  Description of Artificial Sequence: Synthetic peptide
GKGVHLGFDY

SEQ ID NO: 17781 - protein, 10 aa, Artificial Sequence
  Description of Artificial Sequence: Synthetic peptide
GKGVHLGFDY

SEQ ID NO: 17782 - protein, 10 aa, Artificial Sequence
  Description of Artificial Sequence: Synthetic peptide
GKGVHLGFDY

SEQ ID NO: 17783 - protein, 10 aa, Artificial Sequence
  Description of Artificial Sequence: Synthetic peptide
GKGVHLGFDY

SEQ ID NO: 17784 - protein, 10 aa, Artificial Sequence
  Description of Artificial Sequence: Synthetic peptide
GKGVHLGFDY

SEQ ID NO: 17785 - protein, 10 aa, Artificial Sequence
  Description of Artificial Sequence: Synthetic peptide
GKGVHLGFDY

SEQ ID NO: 17786 - protein, 13 aa, Artificial Sequence
  Description of Artificial Sequence: Synthetic peptide
ITIFGVVIIYFDY

SEQ ID NO: 17787 - protein, 14 aa, Artificial Sequence
  Description of Artificial Sequence: Synthetic peptide
HGNFGNSYISYWAY

SEQ ID NO: 17788 - protein, 14 aa, Artificial Sequence
  Description of Artificial Sequence: Synthetic peptide
HGNFGNSYISYWAY

SEQ ID NO: 17789 - protein, 14 aa, Artificial Sequence
  Description of Artificial Sequence: Synthetic peptide
HGNFGNSYISYWAY

SEQ ID NO: 17790 - protein, 13 aa, Artificial Sequence
  Description of Artificial Sequence: Synthetic peptide
AYCGGDCYSYFDY

SEQ ID NO: 17791 - protein, 14 aa, Artificial Sequence
  Description of Artificial Sequence: Synthetic peptide
AGNFGSSYISYWAY

SEQ ID NO: 17792 - protein, 14 aa, Artificial Sequence
  Description of Artificial Sequence: Synthetic peptide
AGNFGSSYISYWAY

SEQ ID NO: 17793 - protein, 14 aa, Artificial Sequence
  Description of Artificial Sequence: Synthetic peptide
AGNFGSSYISYWAY

SEQ ID NO: 17794 - protein, 14 aa, Artificial Sequence
  Description of Artificial Sequence: Synthetic peptide
AGNFGSSYISYWAY

SEQ ID NO: 17795 - protein, 14 aa, Artificial Sequence
  Description of Artificial Sequence: Synthetic peptide
AGNFGSSYISYWAY

SEQ ID NO: 17796 - protein, 14 aa, Artificial Sequence
  Description of Artificial Sequence: Synthetic peptide
AGNFGSSYISYWAY

SEQ ID NO: 17797 - protein, 19 aa, Artificial Sequence
  Description of Artificial Sequence: Synthetic peptide
YYYGSGSYYNYYYYYGMDV

SEQ ID NO: 17798 - protein, 16 aa, Artificial Sequence
  Description of Artificial Sequence: Synthetic peptide
PSYSGSYYNYFSVMDV

SEQ ID NO: 17799 - protein, 16 aa, Artificial Sequence
  Description of Artificial Sequence: Synthetic peptide
PSYSGSYYNYFSVMDV

SEQ ID NO: 17800 - protein, 16 aa, Artificial Sequence
  Description of Artificial Sequence: Synthetic peptide
PSYSGSYYNYFSVMDV

SEQ ID NO: 17801 - protein, 10 aa, Artificial Sequence
  Description of Artificial Sequence: Synthetic peptide
FGQGTKVEIK

SEQ ID NO: 17802 - protein, 10 aa, Artificial Sequence
  Description of Artificial Sequence: Synthetic peptide
FGCGTKVEIK

SEQ ID NO: 17803 - protein, 10 aa, Artificial Sequence
  Description of Artificial Sequence: Synthetic peptide
FGCGTKVEIK

SEQ ID NO: 17804 - protein, 10 aa, Artificial Sequence
  Description of Artificial Sequence: Synthetic peptide
FGCGTKVEIK

SEQ ID NO: 17805 - protein, 10 aa, Artificial Sequence
  Description of Artificial Sequence: Synthetic peptide
FGGGTKLTVL

SEQ ID NO: 17806 - protein, 10 aa, Artificial Sequence
  Description of Artificial Sequence: Synthetic peptide
FGCGTKLTVL

SEQ ID NO: 17807 - protein, 10 aa, Artificial Sequence
  Description of Artificial Sequence: Synthetic peptide
FGCGTKLTVL

SEQ ID NO: 17808 - protein, 10 aa, Artificial Sequence
  Description of Artificial Sequence: Synthetic peptide
FGCGTKLTVL

SEQ ID NO: 17809 - protein, 10 aa, Artificial Sequence
  Description of Artificial Sequence: Synthetic peptide
FGCGTKLTVL

SEQ ID NO: 17810 - protein, 10 aa, Artificial Sequence
  Description of Artificial Sequence: Synthetic peptide
FGCGTKLTVL

SEQ ID NO: 17811 - protein, 10 aa, Artificial Sequence
  Description of Artificial Sequence: Synthetic peptide
FGCGTKLTVL

SEQ ID NO: 17812 - protein, 10 aa, Artificial Sequence
  Description of Artificial Sequence: Synthetic peptide
FGGGTKLTVL

SEQ ID NO: 17813 - protein, 10 aa, Artificial Sequence
  Description of Artificial Sequence: Synthetic peptide
FGGGTKLTVL

SEQ ID NO: 17814 - protein, 10 aa, Artificial Sequence
  Description of Artificial Sequence: Synthetic peptide
FGSGTKLTVL

SEQ ID NO: 17815 - protein, 10 aa, Artificial Sequence
  Description of Artificial Sequence: Synthetic peptide
FGSGTKLTVL

SEQ ID NO: 17816 - protein, 10 aa, Artificial Sequence
  Description of Artificial Sequence: Synthetic peptide
FGGGTKLTVL

SEQ ID NO: 17817 - protein, 10 aa, Artificial Sequence
  Description of Artificial Sequence: Synthetic peptide
FGSGTKLTVL

SEQ ID NO: 17818 - protein, 10 aa, Artificial Sequence
  Description of Artificial Sequence: Synthetic peptide
FGSGTKLTVL

SEQ ID NO: 17819 - protein, 10 aa, Artificial Sequence
  Description of Artificial Sequence: Synthetic peptide
FGGGTKLTVL

SEQ ID NO: 17820 - protein, 10 aa, Artificial Sequence
  Description of Artificial Sequence: Synthetic peptide
FGSGTKLTVL

SEQ ID NO: 17821 - protein, 10 aa, Artificial Sequence
  Description of Artificial Sequence: Synthetic peptide
FGSGTKLTVL

SEQ ID NO: 17822 - protein, 11 aa, Artificial Sequence
  Description of Artificial Sequence: Synthetic peptide
WGQGTLVTVSS

SEQ ID NO: 17823 - protein, 11 aa, Artificial Sequence
  Description of Artificial Sequence: Synthetic peptide
WGQGTLVTVSS

SEQ ID NO: 17824 - protein, 11 aa, Artificial Sequence
  Description of Artificial Sequence: Synthetic peptide
WGQGTLVTVSS

SEQ ID NO: 17825 - protein, 11 aa, Artificial Sequence
  Description of Artificial Sequence: Synthetic peptide
WGQGTLVTVSS

SEQ ID NO: 17826 - protein, 11 aa, Artificial Sequence
  Description of Artificial Sequence: Synthetic peptide
WGQGTLVTVSS

SEQ ID NO: 17827 - protein, 11 aa, Artificial Sequence
  Description of Artificial Sequence: Synthetic peptide
WGQGTLVTVSS

SEQ ID NO: 17828 - protein, 11 aa, Artificial Sequence
  Description of Artificial Sequence: Synthetic peptide
WGQGTLVTVSS

SEQ ID NO: 17829 - protein, 11 aa, Artificial Sequence
  Description of Artificial Sequence: Synthetic peptide
WGQGTLVTVSS

SEQ ID NO: 17830 - protein, 11 aa, Artificial Sequence
  Description of Artificial Sequence: Synthetic peptide
WGQGTLVTVSS

SEQ ID NO: 17831 - protein, 11 aa, Artificial Sequence
  Description of Artificial Sequence: Synthetic peptide
WGQGTLVTVSS

SEQ ID NO: 17832 - protein, 11 aa, Artificial Sequence
  Description of Artificial Sequence: Synthetic peptide
WGQGTLVTVSS

SEQ ID NO: 17833 - protein, 11 aa, Artificial Sequence
  Description of Artificial Sequence: Synthetic peptide
WGQGTLVTVSS

SEQ ID NO: 17834 - protein, 11 aa, Artificial Sequence
  Description of Artificial Sequence: Synthetic peptide
WGQGTLVTVSS

SEQ ID NO: 17835 - protein, 11 aa, Artificial Sequence
  Description of Artificial Sequence: Synthetic peptide
WGQGTLVTVSS

SEQ ID NO: 17836 - protein, 11 aa, Artificial Sequence
  Description of Artificial Sequence: Synthetic peptide
WGQGTLVTVSS

SEQ ID NO: 17837 - protein, 11 aa, Artificial Sequence
  Description of Artificial Sequence: Synthetic peptide
WGQGTLVTVSS

SEQ ID NO: 17838 - protein, 11 aa, Artificial Sequence
  Description of Artificial Sequence: Synthetic peptide
WGQGTLVTVSS

SEQ ID NO: 17839 - protein, 11 aa, Artificial Sequence
  Description of Artificial Sequence: Synthetic peptide
WGQGTLVTVSS

SEQ ID NO: 17840 - protein, 11 aa, Artificial Sequence
  Description of Artificial Sequence: Synthetic peptide
WGQGTTVTVSS

SEQ ID NO: 17841 - protein, 11 aa, Artificial Sequence
  Description of Artificial Sequence: Synthetic peptide
WGQGTTVTVSS

SEQ ID NO: 17842 - protein, 11 aa, Artificial Sequence
  Description of Artificial Sequence: Synthetic peptide
WGQGTTVTVSS

SEQ ID NO: 17843 - protein, 11 aa, Artificial Sequence
  Description of Artificial Sequence: Synthetic peptide
WGQGTTVTVSS

SEQ ID NO: 17844 - protein, 23 aa, Artificial Sequence
  Description of Artificial Sequence: Synthetic peptide
DIQMTQSPSSLSASVGDRVTITC

SEQ ID NO: 17845 - protein, 23 aa, Artificial Sequence
  Description of Artificial Sequence: Synthetic peptide
DIQMTQSPSSLSASVGDRVTITC

SEQ ID NO: 17846 - protein, 23 aa, Artificial Sequence
  Description of Artificial Sequence: Synthetic peptide
DIQMTQSPSSLSASVGDRVTITC

SEQ ID NO: 17847 - protein, 23 aa, Artificial Sequence
  Description of Artificial Sequence: Synthetic peptide
DIQMTQSPSSLSASVGDRVTITC

SEQ ID NO: 17848 - protein, 22 aa, Artificial Sequence
  Description of Artificial Sequence: Synthetic peptide
SYVLTQPPSVSVAPGKTARITC

SEQ ID NO: 17849 - protein, 22 aa, Artificial Sequence
  Description of Artificial Sequence: Synthetic peptide
SYVLTQPPSVSVAPGQTARITC

SEQ ID NO: 17850 - protein, 22 aa, Artificial Sequence
  Description of Artificial Sequence: Synthetic peptide
SYVLTQPPSVSVAPGQTARITC

SEQ ID NO: 17851 - protein, 22 aa, Artificial Sequence
  Description of Artificial Sequence: Synthetic peptide
SYVLTQPPSVSVAPGQTARITC

SEQ ID NO: 17852 - protein, 22 aa, Artificial Sequence
  Description of Artificial Sequence: Synthetic peptide
SYVLTQPPSVSVAPGQTARITC

SEQ ID NO: 17853 - protein, 22 aa, Artificial Sequence
  Description of Artificial Sequence: Synthetic peptide
SYVLTQPPSVSVAPGQTARITC

SEQ ID NO: 17854 - protein, 22 aa, Artificial Sequence
  Description of Artificial Sequence: Synthetic peptide
SYVLTQPPSVSVAPGQTARITC

SEQ ID NO: 17855 - protein, 22 aa, Artificial Sequence
  Description of Artificial Sequence: Synthetic peptide
QTVVTQEPSLTVSPGGTVTLTC

SEQ ID NO: 17856 - protein, 22 aa, Artificial Sequence
  Description of Artificial Sequence: Synthetic peptide
QTVVTQEPSLTVSPGGTVTLTC

SEQ ID NO: 17857 - protein, 22 aa, Artificial Sequence
  Description of Artificial Sequence: Synthetic peptide
QTVVTQEPSLTVSPGGTVTITC

SEQ ID NO: 17858 - protein, 22 aa, Artificial Sequence
  Description of Artificial Sequence: Synthetic peptide
QTVVTQEPSLTVSPGGTVTITC

SEQ ID NO: 17859 - protein, 22 aa, Artificial Sequence
  Description of Artificial Sequence: Synthetic peptide
QTVVTQEPSLTVSPGGTVTLTC

SEQ ID NO: 17860 - protein, 22 aa, Artificial Sequence
  Description of Artificial Sequence: Synthetic peptide
QTVVTQEPSLTVSPGGTVTITC

SEQ ID NO: 17861 - protein, 22 aa, Artificial Sequence
  Description of Artificial Sequence: Synthetic peptide
QTVVTQEPSLTVSPGGTVTITC

SEQ ID NO: 17862 - protein, 22 aa, Artificial Sequence
  Description of Artificial Sequence: Synthetic peptide
QTVVTQEPSLTVSPGGTVTLTC

SEQ ID NO: 17863 - protein, 22 aa, Artificial Sequence
  Description of Artificial Sequence: Synthetic peptide
QTVVTQEPSLTVSPGGTVTITC

SEQ ID NO: 17864 - protein, 22 aa, Artificial Sequence
  Description of Artificial Sequence: Synthetic peptide
QTVVTQEPSLTVSPGGTVTITC

SEQ ID NO: 17865 - protein, 30 aa, Artificial Sequence; identical to SEQ ID NO: 779
  Description of Artificial Sequence: Synthetic polypeptide

SEQ ID NO: 17866 - protein, 30 aa, Artificial Sequence; identical to SEQ ID NO: 779
  Description of Artificial Sequence: Synthetic polypeptide

SEQ ID NO: 17867 - protein, 30 aa, Artificial Sequence; identical to SEQ ID NO: 779
  Description of Artificial Sequence: Synthetic polypeptide

SEQ ID NO: 17868 - protein, 30 aa, Artificial Sequence; identical to SEQ ID NO: 779
  Description of Artificial Sequence: Synthetic polypeptide

SEQ ID NO: 17869 - protein, 30 aa, Artificial Sequence; identical to SEQ ID NO: 779
  Description of Artificial Sequence: Synthetic polypeptide

SEQ ID NO: 17870 - protein, 30 aa, Artificial Sequence; identical to SEQ ID NO: 779
  Description of Artificial Sequence: Synthetic polypeptide

SEQ ID NO: 17871 - protein, 30 aa, Artificial Sequence; identical to SEQ ID NO: 779
  Description of Artificial Sequence: Synthetic polypeptide

SEQ ID NO: 17872 - protein, 30 aa, Artificial Sequence; identical to SEQ ID NO: 793
  Description of Artificial Sequence: Synthetic polypeptide

SEQ ID NO: 17873 - protein, 30 aa, Artificial Sequence; identical to SEQ ID NO: 794
  Description of Artificial Sequence: Synthetic polypeptide

SEQ ID NO: 17874 - protein, 30 aa, Artificial Sequence; identical to SEQ ID NO: 794
  Description of Artificial Sequence: Synthetic polypeptide

SEQ ID NO: 17875 - protein, 30 aa, Artificial Sequence; identical to SEQ ID NO: 794
  Description of Artificial Sequence: Synthetic polypeptide

SEQ ID NO: 17876 - protein, 30 aa, Artificial Sequence; identical to SEQ ID NO: 793
  Description of Artificial Sequence: Synthetic polypeptide

SEQ ID NO: 17877 - protein, 30 aa, Artificial Sequence; identical to SEQ ID NO: 794
  Description of Artificial Sequence: Synthetic polypeptide

SEQ ID NO: 17878 - protein, 30 aa, Artificial Sequence; identical to SEQ ID NO: 794
  Description of Artificial Sequence: Synthetic polypeptide

SEQ ID NO: 17879 - protein, 30 aa, Artificial Sequence; identical to SEQ ID NO: 794
  Description of Artificial Sequence: Synthetic polypeptide

SEQ ID NO: 17880 - protein, 30 aa, Artificial Sequence; identical to SEQ ID NO: 794
  Description of Artificial Sequence: Synthetic polypeptide

SEQ ID NO: 17881 - protein, 30 aa, Artificial Sequence; identical to SEQ ID NO: 794
  Description of Artificial Sequence: Synthetic polypeptide

SEQ ID NO: 17882 - protein, 30 aa, Artificial Sequence; identical to SEQ ID NO: 794
  Description of Artificial Sequence: Synthetic polypeptide

SEQ ID NO: 17883 - protein, 30 aa, Artificial Sequence; identical to SEQ ID NO: 832
  Description of Artificial Sequence: Synthetic polypeptide

SEQ ID NO: 17884 - protein, 30 aa, Artificial Sequence; identical to SEQ ID NO: 833
  Description of Artificial Sequence: Synthetic polypeptide

SEQ ID NO: 17885 - protein, 30 aa, Artificial Sequence; identical to SEQ ID NO: 833
  Description of Artificial Sequence: Synthetic polypeptide

SEQ ID NO: 17886 - protein, 30 aa, Artificial Sequence; identical to SEQ ID NO: 833
  Description of Artificial Sequence: Synthetic polypeptide

SEQ ID NO: 17887 - protein, 11 aa, Artificial Sequence
  Description of Artificial Sequence: Synthetic peptide
RASQSISSYLN

SEQ ID NO: 17888 - protein, 11 aa, Artificial Sequence
  Description of Artificial Sequence: Synthetic peptide
RTSQSISSYLN

SEQ ID NO: 17889 - protein, 11 aa, Artificial Sequence
  Description of Artificial Sequence: Synthetic peptide
RTSQSISSYLN

SEQ ID NO: 17890 - protein, 11 aa, Artificial Sequence
  Description of Artificial Sequence: Synthetic peptide
RTSQSISSYLN

SEQ ID NO: 17891 - protein, 11 aa, Artificial Sequence
  Description of Artificial Sequence: Synthetic peptide
GGNNIGSKSVH

SEQ ID NO: 17892 - protein, 11 aa, Artificial Sequence
  Description of Artificial Sequence: Synthetic peptide
GGNNIGSKSVH

SEQ ID NO: 17893 - protein, 11 aa, Artificial Sequence
  Description of Artificial Sequence: Synthetic peptide
GGNNIGSKSVH

SEQ ID NO: 17894 - protein, 11 aa, Artificial Sequence
  Description of Artificial Sequence: Synthetic peptide
GGNNIGSKSVH

SEQ ID NO: 17895 - protein, 11 aa, Artificial Sequence
  Description of Artificial Sequence: Synthetic peptide
GGNNIGSKSVH

SEQ ID NO: 17896 - protein, 11 aa, Artificial Sequence
  Description of Artificial Sequence: Synthetic peptide
GGNNIGSKSVH

SEQ ID NO: 17897 - protein, 11 aa, Artificial Sequence
  Description of Artificial Sequence: Synthetic peptide
GGNNIGSKSVH

SEQ ID NO: 17898 - protein, 14 aa, Artificial Sequence
  Description of Artificial Sequence: Synthetic peptide
ASSTGAVTSGYYPN

SEQ ID NO: 17899 - protein, 14 aa, Artificial Sequence
  Description of Artificial Sequence: Synthetic peptide
GSSTGAVTSGNYPN

SEQ ID NO: 17900 - protein, 14 aa, Artificial Sequence
  Description of Artificial Sequence: Synthetic peptide
GSSTGAVTSGNYPN

SEQ ID NO: 17901 - protein, 14 aa, Artificial Sequence
  Description of Artificial Sequence: Synthetic peptide
GSSTGAVTSGNYPN

SEQ ID NO: 17902 - protein, 14 aa, Artificial Sequence
  Description of Artificial Sequence: Synthetic peptide
GSSTGAVTSGNYPN

SEQ ID NO: 17903 - protein, 14 aa, Artificial Sequence
  Description of Artificial Sequence: Synthetic peptide
GSSTGAVTSGNYPN

SEQ ID NO: 17904 - protein, 14 aa, Artificial Sequence
  Description of Artificial Sequence: Synthetic peptide
GSSTGAVTSGNYPN

SEQ ID NO: 17905 - protein, 14 aa, Artificial Sequence
  Description of Artificial Sequence: Synthetic peptide
GSSTGAVTSGNYPN

SEQ ID NO: 17906 - protein, 14 aa, Artificial Sequence
  Description of Artificial Sequence: Synthetic peptide
GSSTGAVTSGNYPN

SEQ ID NO: 17907 - protein, 14 aa, Artificial Sequence
  Description of Artificial Sequence: Synthetic peptide
GSSTGAVTSGNYPN

SEQ ID NO: 17908 - protein, 5 aa, Artificial Sequence
  Description of Artificial Sequence: Synthetic peptide
SYAMS

SEQ ID NO: 17909 - protein, 5 aa, Artificial Sequence
  Description of Artificial Sequence: Synthetic peptide
SYAMS

SEQ ID NO: 17910 - protein, 5 aa, Artificial Sequence
  Description of Artificial Sequence: Synthetic peptide
SYAMS

SEQ ID NO: 17911 - protein, 5 aa, Artificial Sequence
  Description of Artificial Sequence: Synthetic peptide
SYAMS

SEQ ID NO: 17912 - protein, 5 aa, Artificial Sequence
  Description of Artificial Sequence: Synthetic peptide
SHAMS

SEQ ID NO: 17913 - protein, 5 aa, Artificial Sequence
  Description of Artificial Sequence: Synthetic peptide
SHAMS

SEQ ID NO: 17914 - protein, 5 aa, Artificial Sequence
  Description of Artificial Sequence: Synthetic peptide
SHAMS

SEQ ID NO: 17915 - protein, 5 aa, Artificial Sequence
  Description of Artificial Sequence: Synthetic peptide
GSAMH

SEQ ID NO: 17916 - protein, 5 aa, Artificial Sequence
  Description of Artificial Sequence: Synthetic peptide
KYAMN

SEQ ID NO: 17917 - protein, 5 aa, Artificial Sequence
  Description of Artificial Sequence: Synthetic peptide
KYAMN

SEQ ID NO: 17918 - protein, 5 aa, Artificial Sequence
  Description of Artificial Sequence: Synthetic peptide
KYAMN

SEQ ID NO: 17919 - protein, 5 aa, Artificial Sequence
  Description of Artificial Sequence: Synthetic peptide
GSAMH

SEQ ID NO: 17920 - protein, 5 aa, Artificial Sequence
  Description of Artificial Sequence: Synthetic peptide
KYAIN

SEQ ID NO: 17921 - protein, 5 aa, Artificial Sequence
  Description of Artificial Sequence: Synthetic peptide
KYAIN

SEQ ID NO: 17922 - protein, 5 aa, Artificial Sequence
  Description of Artificial Sequence: Synthetic peptide
KYAIN

SEQ ID NO: 17923 - protein, 5 aa, Artificial Sequence
  Description of Artificial Sequence: Synthetic peptide
KYAIN

SEQ ID NO: 17924 - protein, 5 aa, Artificial Sequence
  Description of Artificial Sequence: Synthetic peptide
KYAIN

SEQ ID NO: 17925 - protein, 5 aa, Artificial Sequence
  Description of Artificial Sequence: Synthetic peptide
KYAIN

SEQ ID NO: 17926 - protein, 5 aa, Artificial Sequence
  Description of Artificial Sequence: Synthetic peptide
NAWMS

SEQ ID NO: 17927 - protein, 5 aa, Artificial Sequence
  Description of Artificial Sequence: Synthetic peptide
NAWMS

SEQ ID NO: 17928 - protein, 5 aa, Artificial Sequence
  Description of Artificial Sequence: Synthetic peptide
NAWMS

SEQ ID NO: 17929 - protein, 5 aa, Artificial Sequence
  Description of Artificial Sequence: Synthetic peptide
NAWMS

SEQ ID NO: 17930 - protein, 15 aa, Artificial Sequence
  Description of Artificial Sequence: Synthetic peptide
WYQQKPGKAPKLLIY

SEQ ID NO: 17931 - protein, 15 aa, Artificial Sequence
  Description of Artificial Sequence: Synthetic peptide
WYQQKPGRAPKLLIF

SEQ ID NO: 17932 - protein, 15 aa, Artificial Sequence
  Description of Artificial Sequence: Synthetic peptide
WYQQKPGRAPKLLIF

SEQ ID NO: 17933 - protein, 15 aa, Artificial Sequence
  Description of Artificial Sequence: Synthetic peptide
WYQQKPGRAPKLLIF

SEQ ID NO: 17934 - protein, 15 aa, Artificial Sequence
  Description of Artificial Sequence: Synthetic peptide
WYQQKPGQAPVLVIY

SEQ ID NO: 17935 - protein, 15 aa, Artificial Sequence
  Description of Artificial Sequence: Synthetic peptide
WYQQKPGQAPVMVVY

SEQ ID NO: 17936 - protein, 15 aa, Artificial Sequence
  Description of Artificial Sequence: Synthetic peptide
WYQQKPGQAPVMVVY

SEQ ID NO: 17937 - protein, 15 aa, Artificial Sequence
  Description of Artificial Sequence: Synthetic peptide
WYQQKPGQAPVMVVY

SEQ ID NO: 17938 - protein, 15 aa, Artificial Sequence
  Description of Artificial Sequence: Synthetic peptide
WYQQKPGQAPVMVVY

SEQ ID NO: 17939 - protein, 15 aa, Artificial Sequence
  Description of Artificial Sequence: Synthetic peptide
WYQQKPGQAPVMVVY

SEQ ID NO: 17940 - protein, 15 aa, Artificial Sequence
  Description of Artificial Sequence: Synthetic peptide
WYQQKPGQAPVMVVY

SEQ ID NO: 17941 - protein, 15 aa, Artificial Sequence
  Description of Artificial Sequence: Synthetic peptide
WFQQKPGQAPRALIY

SEQ ID NO: 17942 - protein, 15 aa, Artificial Sequence
  Description of Artificial Sequence: Synthetic peptide
WVQQKPGQAPRGLIG

SEQ ID NO: 17943 - protein, 15 aa, Artificial Sequence
  Description of Artificial Sequence: Synthetic peptide
WVQKKPGQAPRGLIG

SEQ ID NO: 17944 - protein, 15 aa, Artificial Sequence
  Description of Artificial Sequence: Synthetic peptide
WVQKKPGQAPRGLIG

SEQ ID NO: 17945 - protein, 15 aa, Artificial Sequence
  Description of Artificial Sequence: Synthetic peptide
WVQQKPGQAPRGLIG

SEQ ID NO: 17946 - protein, 15 aa, Artificial Sequence
  Description of Artificial Sequence: Synthetic peptide
WVQKKPGQAPRGLIG

SEQ ID NO: 17947 - protein, 15 aa, Artificial Sequence
  Description of Artificial Sequence: Synthetic peptide
WVQKKPGQAPRGLIG

SEQ ID NO: 17948 - protein, 15 aa, Artificial Sequence
  Description of Artificial Sequence: Synthetic peptide
WVQQKPGQAPRGLIG

SEQ ID NO: 17949 - protein, 15 aa, Artificial Sequence
  Description of Artificial Sequence: Synthetic peptide
WVQKKPGQAPRGLIG

SEQ ID NO: 17950 - protein, 15 aa, Artificial Sequence
  Description of Artificial Sequence: Synthetic peptide
WVQKKPGQAPRGLIG

SEQ ID NO: 17951 - protein, 14 aa, Artificial Sequence
  Description of Artificial Sequence: Synthetic peptide
WVRQAPGKGLEWVS

SEQ ID NO: 17952 - protein, 14 aa, Artificial Sequence
  Description of Artificial Sequence: Synthetic peptide
WVRQAPGKCLEWVS

SEQ ID NO: 17953 - protein, 14 aa, Artificial Sequence
  Description of Artificial Sequence: Synthetic peptide
WVRQAPGKCLEWVS

SEQ ID NO: 17954 - protein, 14 aa, Artificial Sequence
  Description of Artificial Sequence: Synthetic peptide
WVRQAPGKCLEWVS

SEQ ID NO: 17955 - protein, 14 aa, Artificial Sequence
  Description of Artificial Sequence: Synthetic peptide
WVRQAPGKCLEWVS

SEQ ID NO: 17956 - protein, 14 aa, Artificial Sequence
  Description of Artificial Sequence: Synthetic peptide
WVRQAPGKCLEWVS

SEQ ID NO: 17957 - protein, 14 aa, Artificial Sequence
  Description of Artificial Sequence: Synthetic peptide
WVRQAPGKCLEWVS

SEQ ID NO: 17958 - protein, 14 aa, Artificial Sequence
  Description of Artificial Sequence: Synthetic peptide
WVRQASGKGLEWVG

SEQ ID NO: 17959 - protein, 14 aa, Artificial Sequence
  Description of Artificial Sequence: Synthetic peptide
WVRQAPGKGLEWVA

SEQ ID NO: 17960 - protein, 14 aa, Artificial Sequence
  Description of Artificial Sequence: Synthetic peptide
WVRQAPGKGLEWVA

SEQ ID NO: 17961 - protein, 14 aa, Artificial Sequence
  Description of Artificial Sequence: Synthetic peptide
WVRQAPGKGLEWVA

SEQ ID NO: 17962 - protein, 14 aa, Artificial Sequence
  Description of Artificial Sequence: Synthetic peptide
WVRQASGKGLEWVG

SEQ ID NO: 17963 - protein, 14 aa, Artificial Sequence
  Description of Artificial Sequence: Synthetic peptide
WVRQAPGKGLEWVA

SEQ ID NO: 17964 - protein, 14 aa, Artificial Sequence
  Description of Artificial Sequence: Synthetic peptide
WVRQAPGKGLEWVA

SEQ ID NO: 17965 - protein, 14 aa, Artificial Sequence
  Description of Artificial Sequence: Synthetic peptide
WVRQAPGKGLEWVA

SEQ ID NO: 17966 - protein, 14 aa, Artificial Sequence
  Description of Artificial Sequence: Synthetic peptide
WVRQAPGKGLEWVA

SEQ ID NO: 17967 - protein, 14 aa, Artificial Sequence
  Description of Artificial Sequence: Synthetic peptide
WVRQAPGKGLEWVA

SEQ ID NO: 17968 - protein, 14 aa, Artificial Sequence
  Description of Artificial Sequence: Synthetic peptide
WVRQAPGKGLEWVA

SEQ ID NO: 17969 - protein, 14 aa, Artificial Sequence
  Description of Artificial Sequence: Synthetic peptide
WVRQAPGKGLEWVG

SEQ ID NO: 17970 - protein, 14 aa, Artificial Sequence
  Description of Artificial Sequence: Synthetic peptide
WVRQAPGKCLEWVG

SEQ ID NO: 17971 - protein, 14 aa, Artificial Sequence
  Description of Artificial Sequence: Synthetic peptide
WVRQAPGKCLEWVG

SEQ ID NO: 17972 - protein, 14 aa, Artificial Sequence
  Description of Artificial Sequence: Synthetic peptide
WVRQAPGKCLEWVG

SEQ ID NO: 17973 - protein, 7 aa, Artificial Sequence
  Description of Artificial Sequence: Synthetic peptide
AASSLQS

SEQ ID NO: 17974 - protein, 7 aa, Artificial Sequence
  Description of Artificial Sequence: Synthetic peptide
AASSLQG

SEQ ID NO: 17975 - protein, 7 aa, Artificial Sequence
  Description of Artificial Sequence: Synthetic peptide
AASSLQG

SEQ ID NO: 17976 - protein, 7 aa, Artificial Sequence
  Description of Artificial Sequence: Synthetic peptide
AASSLQG

SEQ ID NO: 17977 - protein, 7 aa, Artificial Sequence
  Description of Artificial Sequence: Synthetic peptide
YDSDRPS

SEQ ID NO: 17978 - protein, 7 aa, Artificial Sequence
  Description of Artificial Sequence: Synthetic peptide
DDNDRPS

SEQ ID NO: 17979 - protein, 7 aa, Artificial Sequence
  Description of Artificial Sequence: Synthetic peptide
DDNDRPS

SEQ ID NO: 17980 - protein, 7 aa, Artificial Sequence
  Description of Artificial Sequence: Synthetic peptide
DDNDRPS

SEQ ID NO: 17981 - protein, 7 aa, Artificial Sequence
  Description of Artificial Sequence: Synthetic peptide
DDNDRPS

SEQ ID NO: 17982 - protein, 7 aa, Artificial Sequence
  Description of Artificial Sequence: Synthetic peptide
DDNDRPS

SEQ ID NO: 17983 - protein, 7 aa, Artificial Sequence
  Description of Artificial Sequence: Synthetic peptide
DDNDRPS

SEQ ID NO: 17984 - protein, 7 aa, Artificial Sequence
  Description of Artificial Sequence: Synthetic peptide
STSNKHS

SEQ ID NO: 17985 - protein, 7 aa, Artificial Sequence
  Description of Artificial Sequence: Synthetic peptide
GTKFLAP

SEQ ID NO: 17986 - protein, 7 aa, Artificial Sequence
  Description of Artificial Sequence: Synthetic peptide
GTKFLAP

SEQ ID NO: 17987 - protein, 7 aa, Artificial Sequence
  Description of Artificial Sequence: Synthetic peptide
GTKFLAP

SEQ ID NO: 17988 - protein, 7 aa, Artificial Sequence
  Description of Artificial Sequence: Synthetic peptide
GTKFLAP

SEQ ID NO: 17989 - protein, 7 aa, Artificial Sequence
  Description of Artificial Sequence: Synthetic peptide
GTKFLAP

SEQ ID NO: 17990 - protein, 7 aa, Artificial Sequence
  Description of Artificial Sequence: Synthetic peptide
GTKFLAP

SEQ ID NO: 17991 - protein, 7 aa, Artificial Sequence
  Description of Artificial Sequence: Synthetic peptide
GTKFLAP

SEQ ID NO: 17992 - protein, 7 aa, Artificial Sequence
  Description of Artificial Sequence: Synthetic peptide
GTKFLAP

SEQ ID NO: 17993 - protein, 7 aa, Artificial Sequence
  Description of Artificial Sequence: Synthetic peptide
GTKFLAP

SEQ ID NO: 17994 - protein, 17 aa, Artificial Sequence
  Description of Artificial Sequence: Synthetic peptide
AISGSGGSTYYADSVKG

SEQ ID NO: 17995 - protein, 17 aa, Artificial Sequence
  Description of Artificial Sequence: Synthetic peptide
AISGSGGGTYYAASVKG

SEQ ID NO: 17996 - protein, 17 aa, Artificial Sequence
  Description of Artificial Sequence: Synthetic peptide
AISGSGGGTYYAASVKG

SEQ ID NO: 17997 - protein, 17 aa, Artificial Sequence
  Description of Artificial Sequence: Synthetic peptide
AISGSGGGTYYAASVKG

SEQ ID NO: 17998 - protein, 17 aa, Artificial Sequence
  Description of Artificial Sequence: Synthetic peptide
SISGSGGGTYYAASVKG

SEQ ID NO: 17999 - protein, 17 aa, Artificial Sequence
  Description of Artificial Sequence: Synthetic peptide
SISGSGGGTYYAASVKG

SEQ ID NO: 18000 - protein, 17 aa, Artificial Sequence
  Description of Artificial Sequence: Synthetic peptide
SISGSGGGTYYAASVKG

SEQ ID NO: 18001 - protein, 19 aa, Artificial Sequence
  Description of Artificial Sequence: Synthetic peptide
RIRSKANSYATAYAASVKG

SEQ ID NO: 18002 - protein, 19 aa, Artificial Sequence
  Description of Artificial Sequence: Synthetic peptide
RIRSKYNNYATYYADSVKD

SEQ ID NO: 18003 - protein, 19 aa, Artificial Sequence
  Description of Artificial Sequence: Synthetic peptide
RIRSKYNNYATYYADSVKD

SEQ ID NO: 18004 - protein, 19 aa, Artificial Sequence
  Description of Artificial Sequence: Synthetic peptide
RIRSKYNNYATYYADSVKD

SEQ ID NO: 18005 - protein, 19 aa, Artificial Sequence
  Description of Artificial Sequence: Synthetic peptide
RIRSKANSYATAYAASVKG

SEQ ID NO: 18006 - protein, 19 aa, Artificial Sequence
  Description of Artificial Sequence: Synthetic peptide
RIRSKYNNYATYYADAVKD

SEQ ID NO: 18007 - protein, 19 aa, Artificial Sequence
  Description of Artificial Sequence: Synthetic peptide
RIRSKYNNYATYYADAVKD

SEQ ID NO: 18008 - protein, 19 aa, Artificial Sequence
  Description of Artificial Sequence: Synthetic peptide
RIRSKYNNYATYYADAVKD

SEQ ID NO: 18009 - protein, 19 aa, Artificial Sequence
  Description of Artificial Sequence: Synthetic peptide
RIRSKYNNYATYYADAVKD

SEQ ID NO: 18010 - protein, 19 aa, Artificial Sequence
  Description of Artificial Sequence: Synthetic peptide
RIRSKYNNYATYYADAVKD

SEQ ID NO: 18011 - protein, 19 aa, Artificial Sequence
  Description of Artificial Sequence: Synthetic peptide
RIRSKYNNYATYYADAVKD

SEQ ID NO: 18012 - protein, 19 aa, Artificial Sequence
  Description of Artificial Sequence: Synthetic peptide
RIKSKTDGGTTDYAAPVKG

SEQ ID NO: 18013 - protein, 19 aa, Artificial Sequence
  Description of Artificial Sequence: Synthetic peptide
RIRSRSYGGTTDYAAPVKG

SEQ ID NO: 18014 - protein, 19 aa, Artificial Sequence
  Description of Artificial Sequence: Synthetic peptide
RIRSRSYGGTTDYAAPVKG

SEQ ID NO: 18015 - protein, 19 aa, Artificial Sequence
  Description of Artificial Sequence: Synthetic peptide
RIRSRSYGGTTDYAAPVKG

SEQ ID NO: 18016 - protein, 32 aa, Artificial Sequence; identical to SEQ ID NO: 1346
  Description of Artificial Sequence: Synthetic polypeptide

SEQ ID NO: 18017 - protein, 32 aa, Artificial Sequence; identical to SEQ ID NO: 1346
  Description of Artificial Sequence: Synthetic polypeptide

SEQ ID NO: 18018 - protein, 32 aa, Artificial Sequence; identical to SEQ ID NO: 1346
  Description of Artificial Sequence: Synthetic polypeptide

SEQ ID NO: 18019 - protein, 32 aa, Artificial Sequence; identical to SEQ ID NO: 1346
  Description of Artificial Sequence: Synthetic polypeptide

SEQ ID NO: 18020 - protein, 32 aa, Artificial Sequence; identical to SEQ ID NO: 1374
  Description of Artificial Sequence: Synthetic polypeptide

SEQ ID NO: 18021 - protein, 32 aa, Artificial Sequence; identical to SEQ ID NO: 1374
  Description of Artificial Sequence: Synthetic polypeptide

SEQ ID NO: 18022 - protein, 32 aa, Artificial Sequence; identical to SEQ ID NO: 1374
  Description of Artificial Sequence: Synthetic polypeptide

SEQ ID NO: 18023 - protein, 32 aa, Artificial Sequence; identical to SEQ ID NO: 1374
  Description of Artificial Sequence: Synthetic polypeptide

SEQ ID NO: 18024 - protein, 32 aa, Artificial Sequence; identical to SEQ ID NO: 1374
  Description of Artificial Sequence: Synthetic polypeptide

SEQ ID NO: 18025 - protein, 32 aa, Artificial Sequence; identical to SEQ ID NO: 1374
  Description of Artificial Sequence: Synthetic polypeptide

SEQ ID NO: 18026 - protein, 32 aa, Artificial Sequence; identical to SEQ ID NO: 1374
  Description of Artificial Sequence: Synthetic polypeptide

SEQ ID NO: 18027 - protein, 32 aa, Artificial Sequence; identical to SEQ ID NO: 1385
  Description of Artificial Sequence: Synthetic polypeptide

SEQ ID NO: 18028 - protein, 32 aa, Artificial Sequence; identical to SEQ ID NO: 1386
  Description of Artificial Sequence: Synthetic polypeptide

SEQ ID NO: 18029 - protein, 32 aa, Artificial Sequence; identical to SEQ ID NO: 17249
  Description of Artificial Sequence: Synthetic polypeptide

SEQ ID NO: 18030 - protein, 32 aa, Artificial Sequence; identical to SEQ ID NO: 17249
  Description of Artificial Sequence: Synthetic polypeptide

SEQ ID NO: 18031 - protein, 32 aa, Artificial Sequence; identical to SEQ ID NO: 1386
  Description of Artificial Sequence: Synthetic polypeptide

SEQ ID NO: 18032 - protein, 32 aa, Artificial Sequence; identical to SEQ ID NO: 17249
  Description of Artificial Sequence: Synthetic polypeptide

SEQ ID NO: 18033 - protein, 32 aa, Artificial Sequence; identical to SEQ ID NO: 17249
  Description of Artificial Sequence: Synthetic polypeptide

SEQ ID NO: 18034 - protein, 32 aa, Artificial Sequence; identical to SEQ ID NO: 1386
  Description of Artificial Sequence: Synthetic polypeptide

SEQ ID NO: 18035 - protein, 32 aa, Artificial Sequence; identical to SEQ ID NO: 17249
  Description of Artificial Sequence: Synthetic polypeptide

SEQ ID NO: 18036 - protein, 32 aa, Artificial Sequence; identical to SEQ ID NO: 17249
  Description of Artificial Sequence: Synthetic polypeptide

SEQ ID NO: 18037 - protein, 32 aa, Artificial Sequence; identical to SEQ ID NO: 1427
  Description of Artificial Sequence: Synthetic polypeptide

SEQ ID NO: 18038 - protein, 32 aa, Artificial Sequence; identical to SEQ ID NO: 1434
  Description of Artificial Sequence: Synthetic polypeptide

SEQ ID NO: 18039 - protein, 32 aa, Artificial Sequence; identical to SEQ ID NO: 1434
  Description of Artificial Sequence: Synthetic polypeptide

SEQ ID NO: 18040 - protein, 32 aa, Artificial Sequence; identical to SEQ ID NO: 1434
  Description of Artificial Sequence: Synthetic polypeptide

SEQ ID NO: 18041 - protein, 32 aa, Artificial Sequence; identical to SEQ ID NO: 1428
  Description of Artificial Sequence: Synthetic polypeptide

SEQ ID NO: 18042 - protein, 32 aa, Artificial Sequence; identical to SEQ ID NO: 1428
  Description of Artificial Sequence: Synthetic polypeptide

SEQ ID NO: 18043 - protein, 32 aa, Artificial Sequence; identical to SEQ ID NO: 1428
  Description of Artificial Sequence: Synthetic polypeptide

SEQ ID NO: 18044 - protein, 32 aa, Artificial Sequence; identical to SEQ ID NO: 1441
  Description of Artificial Sequence: Synthetic polypeptide

SEQ ID NO: 18045 - protein, 32 aa, Artificial Sequence; identical to SEQ ID NO: 1442
  Description of Artificial Sequence: Synthetic polypeptide

SEQ ID NO: 18046 - protein, 32 aa, Artificial Sequence; identical to SEQ ID NO: 1442
  Description of Artificial Sequence: Synthetic polypeptide

SEQ ID NO: 18047 - protein, 32 aa, Artificial Sequence; identical to SEQ ID NO: 1442
  Description of Artificial Sequence: Synthetic polypeptide

SEQ ID NO: 18048 - protein, 32 aa, Artificial Sequence; identical to SEQ ID NO: 1441
  Description of Artificial Sequence: Synthetic polypeptide

SEQ ID NO: 18049 - protein, 32 aa, Artificial Sequence; identical to SEQ ID NO: 17251
  Description of Artificial Sequence: Synthetic polypeptide

SEQ ID NO: 18050 - protein, 32 aa, Artificial Sequence; identical to SEQ ID NO: 17251
  Description of Artificial Sequence: Synthetic polypeptide

SEQ ID NO: 18051 - protein, 32 aa, Artificial Sequence; identical to SEQ ID NO: 17251
  Description of Artificial Sequence: Synthetic polypeptide

SEQ ID NO: 18052 - protein, 32 aa, Artificial Sequence; identical to SEQ ID NO: 17251
  Description of Artificial Sequence: Synthetic polypeptide

SEQ ID NO: 18053 - protein, 32 aa, Artificial Sequence; identical to SEQ ID NO: 17251
  Description of Artificial Sequence: Synthetic polypeptide

SEQ ID NO: 18054 - protein, 32 aa, Artificial Sequence; identical to SEQ ID NO: 17251
  Description of Artificial Sequence: Synthetic polypeptide

SEQ ID NO: 18055 - protein, 32 aa, Artificial Sequence; identical to SEQ ID NO: 1480
  Description of Artificial Sequence: Synthetic polypeptide

SEQ ID NO: 18056 - protein, 32 aa, Artificial Sequence; identical to SEQ ID NO: 1481
  Description of Artificial Sequence: Synthetic polypeptide

SEQ ID NO: 18057 - protein, 32 aa, Artificial Sequence; identical to SEQ ID NO: 1481
  Description of Artificial Sequence: Synthetic polypeptide

SEQ ID NO: 18058 - protein, 32 aa, Artificial Sequence; identical to SEQ ID NO: 1481
  Description of Artificial Sequence: Synthetic polypeptide

SEQ ID NO: 18059 - protein, 9 aa, Artificial Sequence
  Description of Artificial Sequence: Synthetic peptide
QQSYSTPWT

SEQ ID NO: 18060 - protein, 9 aa, Artificial Sequence
  Description of Artificial Sequence: Synthetic peptide
QQTYSMPFT

SEQ ID NO: 18061 - protein, 9 aa, Artificial Sequence
  Description of Artificial Sequence: Synthetic peptide
QQTYSMPFT

SEQ ID NO: 18062 - protein, 9 aa, Artificial Sequence
  Description of Artificial Sequence: Synthetic peptide
QQTYSMPFT

SEQ ID NO: 18063 - protein, 11 aa, Artificial Sequence
  Description of Artificial Sequence: Synthetic peptide
QVWDSSSDHVV

SEQ ID NO: 18064 - protein, 11 aa, Artificial Sequence
  Description of Artificial Sequence: Synthetic peptide
QVWDYSGQRQV

SEQ ID NO: 18065 - protein, 11 aa, Artificial Sequence
  Description of Artificial Sequence: Synthetic peptide
QVWDYSGQRQV

SEQ ID NO: 18066 - protein, 11 aa, Artificial Sequence
  Description of Artificial Sequence: Synthetic peptide
QVWDYSGQRQV

SEQ ID NO: 18067 - protein, 11 aa, Artificial Sequence
  Description of Artificial Sequence: Synthetic peptide
QVWDYSPLRHV

SEQ ID NO: 18068 - protein, 11 aa, Artificial Sequence
  Description of Artificial Sequence: Synthetic peptide
QVWDYSPLRHV

SEQ ID NO: 18069 - protein, 11 aa, Artificial Sequence
  Description of Artificial Sequence: Synthetic peptide
QVWDYSPLRHV

SEQ ID NO: 18070 - protein, 10 aa, Artificial Sequence
  Description of Artificial Sequence: Synthetic peptide
LLYYGGAQWV

SEQ ID NO: 18071 - protein, 9 aa, Artificial Sequence
  Description of Artificial Sequence: Synthetic peptide
VLWYSNRWV

SEQ ID NO: 18072 - protein, 9 aa, Artificial Sequence
  Description of Artificial Sequence: Synthetic peptide
VLWYSNRWV

SEQ ID NO: 18073 - protein, 9 aa, Artificial Sequence
  Description of Artificial Sequence: Synthetic peptide
VLWYSNRWV

SEQ ID NO: 18074 - protein, 9 aa, Artificial Sequence
  Description of Artificial Sequence: Synthetic peptide
VLWYSNRWV

SEQ ID NO: 18075 - protein, 9 aa, Artificial Sequence
  Description of Artificial Sequence: Synthetic peptide
VLWYSNRWV

SEQ ID NO: 18076 - protein, 9 aa, Artificial Sequence
  Description of Artificial Sequence: Synthetic peptide
VLWYSNRWV

SEQ ID NO: 18077 - protein, 9 aa, Artificial Sequence
  Description of Artificial Sequence: Synthetic peptide
VLWYSNRWV

SEQ ID NO: 18078 - protein, 9 aa, Artificial Sequence
  Description of Artificial Sequence: Synthetic peptide
VLWYSNRWV

SEQ ID NO: 18079 - protein, 9 aa, Artificial Sequence
  Description of Artificial Sequence: Synthetic peptide
VLWYSNRWV

SEQ ID NO: 18080 - protein, 10 aa, Artificial Sequence
  Description of Artificial Sequence: Synthetic peptide
GIAVAGYFDY

SEQ ID NO: 18081 - protein, 10 aa, Artificial Sequence
  Description of Artificial Sequence: Synthetic peptide
GKGVHLGFDY

SEQ ID NO: 18082 - protein, 10 aa, Artificial Sequence
  Description of Artificial Sequence: Synthetic peptide
GKGVHLGFDY

SEQ ID NO: 18083 - protein, 10 aa, Artificial Sequence
  Description of Artificial Sequence: Synthetic peptide
GKGVHLGFDY

SEQ ID NO: 18084 - protein, 10 aa, Artificial Sequence
  Description of Artificial Sequence: Synthetic peptide
GKGVHLGFDY

SEQ ID NO: 18085 - protein, 10 aa, Artificial Sequence
  Description of Artificial Sequence: Synthetic peptide
GKGVHLGFDY

SEQ ID NO: 18086 - protein, 10 aa, Artificial Sequence
  Description of Artificial Sequence: Synthetic peptide
GKGVHLGFDY

SEQ ID NO: 18087 - protein, 13 aa, Artificial Sequence
  Description of Artificial Sequence: Synthetic peptide
ITIFGVVIIYFDY

SEQ ID NO: 18088 - protein, 14 aa, Artificial Sequence
  Description of Artificial Sequence: Synthetic peptide
HGNFGNSYISYWAY

SEQ ID NO: 18089 - protein, 14 aa, Artificial Sequence
  Description of Artificial Sequence: Synthetic peptide
HGNFGNSYISYWAY

SEQ ID NO: 18090 - protein, 14 aa, Artificial Sequence
  Description of Artificial Sequence: Synthetic peptide
HGNFGNSYISYWAY

SEQ ID NO: 18091 - protein, 13 aa, Artificial Sequence
  Description of Artificial Sequence: Synthetic peptide
AYCGGDCYSYFDY

SEQ ID NO: 18092 - protein, 14 aa, Artificial Sequence
  Description of Artificial Sequence: Synthetic peptide
AGNFGSSYISYWAY

SEQ ID NO: 18093 - protein, 14 aa, Artificial Sequence
  Description of Artificial Sequence: Synthetic peptide
AGNFGSSYISYWAY

SEQ ID NO: 18094 - protein, 14 aa, Artificial Sequence
  Description of Artificial Sequence: Synthetic peptide
AGNFGSSYISYWAY

SEQ ID NO: 18095 - protein, 14 aa, Artificial Sequence
  Description of Artificial Sequence: Synthetic peptide
AGNFGSSYISYWAY

SEQ ID NO: 18096 - protein, 14 aa, Artificial Sequence
  Description of Artificial Sequence: Synthetic peptide
AGNFGSSYISYWAY

SEQ ID NO: 18097 - protein, 14 aa, Artificial Sequence
  Description of Artificial Sequence: Synthetic peptide
AGNFGSSYISYWAY

SEQ ID NO: 18098 - protein, 19 aa, Artificial Sequence
  Description of Artificial Sequence: Synthetic peptide
YYYGSGSYYNYYYYYGMDV

SEQ ID NO: 18099 - protein, 16 aa, Artificial Sequence
  Description of Artificial Sequence: Synthetic peptide
PSYSGSYYNYFSVMDV

SEQ ID NO: 18100 - protein, 16 aa, Artificial Sequence
  Description of Artificial Sequence: Synthetic peptide
PSYSGSYYNYFSVMDV

SEQ ID NO: 18101 - protein, 16 aa, Artificial Sequence
  Description of Artificial Sequence: Synthetic peptide
PSYSGSYYNYFSVMDV

SEQ ID NO: 18102 - protein, 10 aa, Artificial Sequence
  Description of Artificial Sequence: Synthetic peptide
FGQGTKVEIK

SEQ ID NO: 18103 - protein, 10 aa, Artificial Sequence
  Description of Artificial Sequence: Synthetic peptide
FGCGTKVEIK

SEQ ID NO: 18104 - protein, 10 aa, Artificial Sequence
  Description of Artificial Sequence: Synthetic peptide
FGCGTKVEIK

SEQ ID NO: 18105 - protein, 10 aa, Artificial Sequence
  Description of Artificial Sequence: Synthetic peptide
FGCGTKVEIK

SEQ ID NO: 18106 - protein, 10 aa, Artificial Sequence
  Description of Artificial Sequence: Synthetic peptide
FGGGTKLTVL

SEQ ID NO: 18107 - protein, 10 aa, Artificial Sequence
  Description of Artificial Sequence: Synthetic peptide
FGCGTKLTVL

SEQ ID NO: 18108 - protein, 10 aa, Artificial Sequence
  Description of Artificial Sequence: Synthetic peptide
FGCGTKLTVL

SEQ ID NO: 18109 - protein, 10 aa, Artificial Sequence
  Description of Artificial Sequence: Synthetic peptide
FGCGTKLTVL

SEQ ID NO: 18110 - protein, 10 aa, Artificial Sequence
  Description of Artificial Sequence: Synthetic peptide
FGCGTKLTVL

SEQ ID NO: 18111 - protein, 10 aa, Artificial Sequence
  Description of Artificial Sequence: Synthetic peptide
FGCGTKLTVL

SEQ ID NO: 18112 - protein, 10 aa, Artificial Sequence
  Description of Artificial Sequence: Synthetic peptide
FGCGTKLTVL

SEQ ID NO: 18113 - protein, 10 aa, Artificial Sequence
  Description of Artificial Sequence: Synthetic peptide
FGGGTKLTVL

SEQ ID NO: 18114 - protein, 10 aa, Artificial Sequence
  Description of Artificial Sequence: Synthetic peptide
FGGGTKLTVL

SEQ ID NO: 18115 - protein, 10 aa, Artificial Sequence
  Description of Artificial Sequence: Synthetic peptide
FGSGTKLTVL

SEQ ID NO: 18116 - protein, 10 aa, Artificial Sequence
  Description of Artificial Sequence: Synthetic peptide
FGSGTKLTVL

SEQ ID NO: 18117 - protein, 10 aa, Artificial Sequence
  Description of Artificial Sequence: Synthetic peptide
FGGGTKLTVL

SEQ ID NO: 18118 - protein, 10 aa, Artificial Sequence
  Description of Artificial Sequence: Synthetic peptide
FGSGTKLTVL

SEQ ID NO: 18119 - protein, 10 aa, Artificial Sequence
  Description of Artificial Sequence: Synthetic peptide
FGSGTKLTVL

SEQ ID NO: 18120 - protein, 10 aa, Artificial Sequence
  Description of Artificial Sequence: Synthetic peptide
FGGGTKLTVL

SEQ ID NO: 18121 - protein, 10 aa, Artificial Sequence
  Description of Artificial Sequence: Synthetic peptide
FGSGTKLTVL

SEQ ID NO: 18122 - protein, 10 aa, Artificial Sequence
  Description of Artificial Sequence: Synthetic peptide
FGSGTKLTVL

SEQ ID NO: 18123 - protein, 11 aa, Artificial Sequence
  Description of Artificial Sequence: Synthetic peptide
WGQGTLVTVSS

SEQ ID NO: 18124 - protein, 11 aa, Artificial Sequence
  Description of Artificial Sequence: Synthetic peptide
WGQGTLVTVSS

SEQ ID NO: 18125 - protein, 11 aa, Artificial Sequence
  Description of Artificial Sequence: Synthetic peptide
WGQGTLVTVSS

SEQ ID NO: 18126 - protein, 11 aa, Artificial Sequence
  Description of Artificial Sequence: Synthetic peptide
WGQGTLVTVSS

SEQ ID NO: 18127 - protein, 11 aa, Artificial Sequence
  Description of Artificial Sequence: Synthetic peptide
WGQGTLVTVSS

SEQ ID NO: 18128 - protein, 11 aa, Artificial Sequence
  Description of Artificial Sequence: Synthetic peptide
WGQGTLVTVSS

SEQ ID NO: 18129 - protein, 11 aa, Artificial Sequence
  Description of Artificial Sequence: Synthetic peptide
WGQGTLVTVSS

SEQ ID NO: 18130 - protein, 11 aa, Artificial Sequence
  Description of Artificial Sequence: Synthetic peptide
WGQGTLVTVSS

SEQ ID NO: 18131 - protein, 11 aa, Artificial Sequence
  Description of Artificial Sequence: Synthetic peptide
WGQGTLVTVSS

SEQ ID NO: 18132 - protein, 11 aa, Artificial Sequence
  Description of Artificial Sequence: Synthetic peptide
WGQGTLVTVSS

SEQ ID NO: 18133 - protein, 11 aa, Artificial Sequence
  Description of Artificial Sequence: Synthetic peptide
WGQGTLVTVSS

SEQ ID NO: 18134 - protein, 11 aa, Artificial Sequence
  Description of Artificial Sequence: Synthetic peptide
WGQGTLVTVSS

SEQ ID NO: 18135 - protein, 11 aa, Artificial Sequence
  Description of Artificial Sequence: Synthetic peptide
WGQGTLVTVSS

SEQ ID NO: 18136 - protein, 11 aa, Artificial Sequence
  Description of Artificial Sequence: Synthetic peptide
WGQGTLVTVSS

SEQ ID NO: 18137 - protein, 11 aa, Artificial Sequence
  Description of Artificial Sequence: Synthetic peptide
WGQGTLVTVSS

SEQ ID NO: 18138 - protein, 11 aa, Artificial Sequence
  Description of Artificial Sequence: Synthetic peptide
WGQGTLVTVSS

SEQ ID NO: 18139 - protein, 11 aa, Artificial Sequence
  Description of Artificial Sequence: Synthetic peptide
WGQGTLVTVSS

SEQ ID NO: 18140 - protein, 11 aa, Artificial Sequence
  Description of Artificial Sequence: Synthetic peptide
WGQGTLVTVSS

SEQ ID NO: 18141 - protein, 11 aa, Artificial Sequence
  Description of Artificial Sequence: Synthetic peptide
WGQGTTVTVSS

SEQ ID NO: 18142 - protein, 11 aa, Artificial Sequence
  Description of Artificial Sequence: Synthetic peptide
WGQGTTVTVSS

SEQ ID NO: 18143 - protein, 11 aa, Artificial Sequence
  Description of Artificial Sequence: Synthetic peptide
WGQGTTVTVSS

SEQ ID NO: 18144 - protein, 11 aa, Artificial Sequence
  Description of Artificial Sequence: Synthetic peptide
WGQGTTVTVSS

SEQ ID NO: 18145 - protein, 525 aa, Artificial Sequence
  Description of Artificial Sequence: Synthetic polypeptide
MDMRVPAQLLGLLLLWLRGARCEVQLLESGGGLVQPGGSLRLSCAASGFTFSSYAMSWVRQAPGKCLEWVSAISGSGGGTYYAASVKGRFTISRDNSKNTLYLQMSSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGCGTKLTVLSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLHHHHHH

SEQ ID NO: 18146 - protein, 532 aa, Artificial Sequence
  Description of Artificial Sequence: Synthetic polypeptide
MDMRVPAQLLGLLLLWLRGARCEVQLVESGGGLVQPGGSLRLSCAASGFTFSNAWMSWVRQAPGKCLEWVGRIRSRSYGGTTDYAAPVKGRFTISRDDSKNTLFLQMNSLKTEDTAVYYCTTPSYSGSYYNYFSVMDVWGQGTTVTVSSGGGGSGGGGSGGGGSDIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVEIKSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLHHHHHH

SEQ ID NO: 18147 - protein, 525 aa, Artificial Sequence
  Description of Artificial Sequence: Synthetic polypeptide
MDMRVPAQLLGLLLLWLRGARCEVQLLESGGGLVQPGGSLRLSCAASGFTFSSHAMSWVRQAPGKCLEWVSSISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSPLRHVFGCGTKLTVLSGGGGSEVQLVESGGGLVQPGGSLKLSCAASGFTFNKYAINWVRQAPGKGLEWVARIRSKYNNYATYYADAVKDRFTISRDDSKNTVYLQMNNLKTEDTAVYYCARAGNFGSSYISYWAYWGQGTLVTVSSGGGGSGGGGSGGGGSQTVVTQEPSLTVSPGGTVTITCGSSTGAVTSGNYPNWVQKKPGQAPRGLIGGTKFLAPGTPARFSGSLSGGKAALTLSGVQPEDEAEYYCVLWYSNRWVFGSGTKLTVLHHHHHH

SEQ ID NO: 18148 - protein, 11 aa, Artificial Sequence
  Description of Artificial Sequence: Synthetic peptide
GGNNIGSKSVH

SEQ ID NO: 18149 - protein, 11 aa, Artificial Sequence
  Description of Artificial Sequence: Synthetic peptide
RTSQSISSYLN

SEQ ID NO: 18150 - protein, 11 aa, Artificial Sequence
  Description of Artificial Sequence: Synthetic peptide
GGNNIGSKSVH

SEQ ID NO: 18151 - protein, 5 aa, Artificial Sequence
  Description of Artificial Sequence: Synthetic peptide
SYAMS

SEQ ID NO: 18152 - protein, 5 aa, Artificial Sequence
  Description of Artificial Sequence: Synthetic peptide
NAWMS

SEQ ID NO: 18153 - protein, 5 aa, Artificial Sequence
  Description of Artificial Sequence: Synthetic peptide
SHAMS

SEQ ID NO: 18154 - protein, 14 aa, Artificial Sequence
  Description of Artificial Sequence: Synthetic peptide
GSSTGAVTSGNYPN

SEQ ID NO: 18155 - protein, 14 aa, Artificial Sequence
  Description of Artificial Sequence: Synthetic peptide
GSSTGAVTSGNYPN

SEQ ID NO: 18156 - protein, 14 aa, Artificial Sequence
  Description of Artificial Sequence: Synthetic peptide
GSSTGAVTSGNYPN

SEQ ID NO: 18157 - protein, 5 aa, Artificial Sequence
  Description of Artificial Sequence: Synthetic peptide
KYAIN

SEQ ID NO: 18158 - protein, 5 aa, Artificial Sequence
  Description of Artificial Sequence: Synthetic peptide
KYAIN

SEQ ID NO: 18159 - protein, 5 aa, Artificial Sequence
  Description of Artificial Sequence: Synthetic peptide
KYAIN

SEQ ID NO: 18160 - protein, 7 aa, Artificial Sequence
  Description of Artificial Sequence: Synthetic peptide
DDNDRPS

SEQ ID NO: 18161 - protein, 7 aa, Artificial Sequence
  Description of Artificial Sequence: Synthetic peptide
AASSLQG

SEQ ID NO: 18162 - protein, 7 aa, Artificial Sequence
  Description of Artificial Sequence: Synthetic peptide
DDNDRPS

SEQ ID NO: 18163 - protein, 17 aa, Artificial Sequence
  Description of Artificial Sequence: Synthetic peptide
AISGSGGGTYYAASVKG

SEQ ID NO: 18164 - protein, 19 aa, Artificial Sequence
  Description of Artificial Sequence: Synthetic peptide
RIRSRSYGGTTDYAAPVKG

SEQ ID NO: 18165 - protein, 17 aa, Artificial Sequence
  Description of Artificial Sequence: Synthetic peptide
SISGSGGGTYYAASVKG

SEQ ID NO: 18166 - protein, 7 aa, Artificial Sequence
  Description of Artificial Sequence: Synthetic peptide
GTKFLAP

SEQ ID NO: 18167 - protein, 7 aa, Artificial Sequence
  Description of Artificial Sequence: Synthetic peptide
GTKFLAP

SEQ ID NO: 18168 - protein, 7 aa, Artificial Sequence
  Description of Artificial Sequence: Synthetic peptide
GTKFLAP

SEQ ID NO: 18169 - protein, 19 aa, Artificial Sequence
  Description of Artificial Sequence: Synthetic peptide
RIRSKYNNYATYYADAVKD

SEQ ID NO: 18170 - protein, 19 aa, Artificial Sequence
  Description of Artificial Sequence: Synthetic peptide
RIRSKYNNYATYYADAVKD

SEQ ID NO: 18171 - protein, 19 aa, Artificial Sequence
  Description of Artificial Sequence: Synthetic peptide
RIRSKYNNYATYYADAVKD

SEQ ID NO: 18172 - protein, 11 aa, Artificial Sequence
  Description of Artificial Sequence: Synthetic peptide
QVWDYSGQRQV

SEQ ID NO: 18173 - protein, 9 aa, Artificial Sequence
  Description of Artificial Sequence: Synthetic peptide
QQTYSMPFT

SEQ ID NO: 18174 - protein, 11 aa, Artificial Sequence
  Description of Artificial Sequence: Synthetic peptide
QVWDYSPLRHV

SEQ ID NO: 18175 - protein, 10 aa, Artificial Sequence
  Description of Artificial Sequence: Synthetic peptide
GKGVHLGFDY

SEQ ID NO: 18176 - protein, 16 aa, Artificial Sequence
  Description of Artificial Sequence: Synthetic peptide
PSYSGSYYNYFSVMDV

SEQ ID NO: 18177 - protein, 10 aa, Artificial Sequence
  Description of Artificial Sequence: Synthetic peptide
GKGVHLGFDY

SEQ ID NO: 18178 - protein, 9 aa, Artificial Sequence
  Description of Artificial Sequence: Synthetic peptide
VLWYSNRWV

SEQ ID NO: 18179 - protein, 9 aa, Artificial Sequence
  Description of Artificial Sequence: Synthetic peptide
VLWYSNRWV

SEQ ID NO: 18180 - protein, 9 aa, Artificial Sequence
  Description of Artificial Sequence: Synthetic peptide
VLWYSNRWV

SEQ ID NO: 18181 - protein, 14 aa, Artificial Sequence
  Description of Artificial Sequence: Synthetic peptide
AGNFGSSYISYWAY

SEQ ID NO: 18182 - protein, 14 aa, Artificial Sequence
  Description of Artificial Sequence: Synthetic peptide
AGNFGSSYISYWAY

SEQ ID NO: 18183 - protein, 14 aa, Artificial Sequence
  Description of Artificial Sequence: Synthetic peptide
AGNFGSSYISYWAY

SEQ ID NO: 18184 - protein, 108 aa, Artificial Sequence; identical to SEQ ID NO: 576
  Description of Artificial Sequence: Synthetic polypeptide

SEQ ID NO: 18185 - protein, 107 aa, Artificial Sequence; identical to SEQ ID NO: 628
  Description of Artificial Sequence: Synthetic polypeptide

SEQ ID NO: 18186 - protein, 108 aa, Artificial Sequence; identical to SEQ ID NO: 684
  Description of Artificial Sequence: Synthetic polypeptide

SEQ ID NO: 18187 - protein, 119 aa, Artificial Sequence; identical to SEQ ID NO: 577
  Description of Artificial Sequence: Synthetic polypeptide

SEQ ID NO: 18188 - protein, 127 aa, Artificial Sequence; identical to SEQ ID NO: 629
  Description of Artificial Sequence: Synthetic polypeptide

SEQ ID NO: 18189 - protein, 119 aa, Artificial Sequence; identical to SEQ ID NO: 685
  Description of Artificial Sequence: Synthetic polypeptide

SEQ ID NO: 18190 - protein, 109 aa, Artificial Sequence; identical to SEQ ID NO: 17230
  Description of Artificial Sequence: Synthetic polypeptide

SEQ ID NO: 18191 - protein, 109 aa, Artificial Sequence; identical to SEQ ID NO: 17230
  Description of Artificial Sequence: Synthetic polypeptide

SEQ ID NO: 18192 - protein, 109 aa, Artificial Sequence; identical to SEQ ID NO: 17230
  Description of Artificial Sequence: Synthetic polypeptide

SEQ ID NO: 18193 - protein, 125 aa, Artificial Sequence; identical to SEQ ID NO: 17231
  Description of Artificial Sequence: Synthetic polypeptide

SEQ ID NO: 18194 - protein, 125 aa, Artificial Sequence; identical to SEQ ID NO: 17231
  Description of Artificial Sequence: Synthetic polypeptide

SEQ ID NO: 18195 - protein, 125 aa, Artificial Sequence; identical to SEQ ID NO: 17231
  Description of Artificial Sequence: Synthetic polypeptide

SEQ ID NO: 18196 - protein, 23 aa, Artificial Sequence
  Description of Artificial Sequence: Synthetic peptide
DIQMTQSPSSLSASVGDRVTITC

SEQ ID NO: 18197 - protein, 23 aa, Artificial Sequence
  Description of Artificial Sequence: Synthetic peptide
DIQMTQSPSSLSASVGDRVTITC

SEQ ID NO: 18198 - protein, 22 aa, Artificial Sequence
  Description of Artificial Sequence: Synthetic peptide
SYVLTQPPSVSVAPGKTARITC

SEQ ID NO: 18199 - protein, 22 aa, Artificial Sequence
  Description of Artificial Sequence: Synthetic peptide
SYVLTQPPSVSVAPGQTARITC

SEQ ID NO: 18200 - protein, 22 aa, Artificial Sequence
  Description of Artificial Sequence: Synthetic peptide
SYVLTQPPSVSVAPGQTARITC

SEQ ID NO: 18201 - protein, 22 aa, Artificial Sequence
  Description of Artificial Sequence: Synthetic peptide
QTVVTQEPSLTVSPGGTVTLTC

SEQ ID NO: 18202 - protein, 22 aa, Artificial Sequence
  Description of Artificial Sequence: Synthetic peptide
QTVVTQEPSLTVSPGGTVTITC

SEQ ID NO: 18203 - protein, 22 aa, Artificial Sequence
  Description of Artificial Sequence: Synthetic peptide
QTVVTQEPSLTVSPGGTVTITC

SEQ ID NO: 18204 - protein, 22 aa, Artificial Sequence
  Description of Artificial Sequence: Synthetic peptide
QTVVTQEPSLTVSPGGTVTITC

SEQ ID NO: 18205 - protein, 30 aa, Artificial Sequence; identical to SEQ ID NO: 779
  Description of Artificial Sequence: Synthetic polypeptide

SEQ ID NO: 18206 - protein, 30 aa, Artificial Sequence; identical to SEQ ID NO: 779
  Description of Artificial Sequence: Synthetic polypeptide

SEQ ID NO: 18207 - protein, 30 aa, Artificial Sequence; identical to SEQ ID NO: 779
  Description of Artificial Sequence: Synthetic polypeptide

SEQ ID NO: 18208 - protein, 30 aa, Artificial Sequence; identical to SEQ ID NO: 793
  Description of Artificial Sequence: Synthetic polypeptide

SEQ ID NO: 18209 - protein, 30 aa, Artificial Sequence; identical to SEQ ID NO: 794
  Description of Artificial Sequence: Synthetic polypeptide

SEQ ID NO: 18210 - protein, 30 aa, Artificial Sequence; identical to SEQ ID NO: 794
  Description of Artificial Sequence: Synthetic polypeptide

SEQ ID NO: 18211 - protein, 30 aa, Artificial Sequence; identical to SEQ ID NO: 794
  Description of Artificial Sequence: Synthetic polypeptide

SEQ ID NO: 18212 - protein, 30 aa, Artificial Sequence; identical to SEQ ID NO: 832
  Description of Artificial Sequence: Synthetic polypeptide

SEQ ID NO: 18213 - protein, 30 aa, Artificial Sequence; identical to SEQ ID NO: 833
  Description of Artificial Sequence: Synthetic polypeptide

SEQ ID NO: 18214 - protein, 11 aa, Artificial Sequence
  Description of Artificial Sequence: Synthetic peptide
RASQSISSYLN

SEQ ID NO: 18215 - protein, 11 aa, Artificial Sequence
  Description of Artificial Sequence: Synthetic peptide
RTSQSISSYLN

SEQ ID NO: 18216 - protein, 11 aa, Artificial Sequence
  Description of Artificial Sequence: Synthetic peptide
GGNNIGSKSVH

SEQ ID NO: 18217 - protein, 11 aa, Artificial Sequence
  Description of Artificial Sequence: Synthetic peptide
GGNNIGSKSVH

SEQ ID NO: 18218 - protein, 11 aa, Artificial Sequence
  Description of Artificial Sequence: Synthetic peptide
GGNNIGSKSVH

SEQ ID NO: 18219 - protein, 14 aa, Artificial Sequence
  Description of Artificial Sequence: Synthetic peptide
ASSTGAVTSGYYPN

SEQ ID NO: 18220 - protein, 14 aa, Artificial Sequence
  Description of Artificial Sequence: Synthetic peptide
GSSTGAVTSGNYPN

SEQ ID NO: 18221 - protein, 14 aa, Artificial Sequence
  Description of Artificial Sequence: Synthetic peptide
GSSTGAVTSGNYPN

SEQ ID NO: 18222 - protein, 14 aa, Artificial Sequence
  Description of Artificial Sequence: Synthetic peptide
GSSTGAVTSGNYPN

SEQ ID NO: 18223 - protein, 5 aa, Artificial Sequence
  Description of Artificial Sequence: Synthetic peptide
SYAMS

SEQ ID NO: 18224 - protein, 5 aa, Artificial Sequence
  Description of Artificial Sequence: Synthetic peptide
SYAMS

SEQ ID NO: 18225 - protein, 5 aa, Artificial Sequence
  Description of Artificial Sequence: Synthetic peptide
SHAMS

SEQ ID NO: 18226 - protein, 5 aa, Artificial Sequence
  Description of Artificial Sequence: Synthetic peptide
GSAMH

SEQ ID NO: 18227 - protein, 5 aa, Artificial Sequence
  Description of Artificial Sequence: Synthetic peptide
KYAIN

SEQ ID NO: 18228 - protein, 5 aa, Artificial Sequence
  Description of Artificial Sequence: Synthetic peptide
KYAIN

SEQ ID NO: 18229 - protein, 5 aa, Artificial Sequence
  Description of Artificial Sequence: Synthetic peptide
KYAIN

SEQ ID NO: 18230 - protein, 5 aa, Artificial Sequence
  Description of Artificial Sequence: Synthetic peptide
NAWMS

SEQ ID NO: 18231 - protein, 5 aa, Artificial Sequence
  Description of Artificial Sequence: Synthetic peptide
NAWMS

SEQ ID NO: 18232 - protein, 15 aa, Artificial Sequence
  Description of Artificial Sequence: Synthetic peptide
WYQQKPGKAPKLLIY

SEQ ID NO: 18233 - protein, 15 aa, Artificial Sequence
  Description of Artificial Sequence: Synthetic peptide
WYQQKPGRAPKLLIF

SEQ ID NO: 18234 - protein, 15 aa, Artificial Sequence
  Description of Artificial Sequence: Synthetic peptide
WYQQKPGQAPVLVIY

SEQ ID NO: 18235 - protein, 15 aa, Artificial Sequence
  Description of Artificial Sequence: Synthetic peptide
WYQQKPGQAPVMVVY

SEQ ID NO: 18236 - protein, 15 aa, Artificial Sequence
  Description of Artificial Sequence: Synthetic peptide
WYQQKPGQAPVMVVY

SEQ ID NO: 18237 - protein, 15 aa, Artificial Sequence
  Description of Artificial Sequence: Synthetic peptide
WFQQKPGQAPRALIY

SEQ ID NO: 18238 - protein, 15 aa, Artificial Sequence
  Description of Artificial Sequence: Synthetic peptide
WVQKKPGQAPRGLIG

SEQ ID NO: 18239 - protein, 15 aa, Artificial Sequence
  Description of Artificial Sequence: Synthetic peptide
WVQKKPGQAPRGLIG

SEQ ID NO: 18240 - protein, 15 aa, Artificial Sequence
  Description of Artificial Sequence: Synthetic peptide
WVQKKPGQAPRGLIG

SEQ ID NO: 18241 - protein, 14 aa, Artificial Sequence
  Description of Artificial Sequence: Synthetic peptide
WVRQAPGKGLEWVS

SEQ ID NO: 18242 - protein, 14 aa, Artificial Sequence
  Description of Artificial Sequence: Synthetic peptide
WVRQAPGKCLEWVS

SEQ ID NO: 18243 - protein, 14 aa, Artificial Sequence
  Description of Artificial Sequence: Synthetic peptide
WVRQAPGKCLEWVS

SEQ ID NO: 18244 - protein, 14 aa, Artificial Sequence
  Description of Artificial Sequence: Synthetic peptide
WVRQASGKGLEWVG

SEQ ID NO: 18245 - protein, 14 aa, Artificial Sequence
  Description of Artificial Sequence: Synthetic peptide
WVRQAPGKGLEWVA

SEQ ID NO: 18246 - protein, 14 aa, Artificial Sequence
  Description of Artificial Sequence: Synthetic peptide
WVRQAPGKGLEWVA

SEQ ID NO: 18247 - protein, 14 aa, Artificial Sequence
  Description of Artificial Sequence: Synthetic peptide
WVRQAPGKGLEWVA

SEQ ID NO: 18248 - protein, 14 aa, Artificial Sequence
  Description of Artificial Sequence: Synthetic peptide
WVRQAPGKGLEWVG

SEQ ID NO: 18249 - protein, 14 aa, Artificial Sequence
  Description of Artificial Sequence: Synthetic peptide
WVRQAPGKCLEWVG

SEQ ID NO: 18250 - protein, 7 aa, Artificial Sequence
  Description of Artificial Sequence: Synthetic peptide
AASSLQS

SEQ ID NO: 18251 - protein, 7 aa, Artificial Sequence
  Description of Artificial Sequence: Synthetic peptide
AASSLQG

SEQ ID NO: 18252 - protein, 7 aa, Artificial Sequence
  Description of Artificial Sequence: Synthetic peptide
YDSDRPS

SEQ ID NO: 18253 - protein, 7 aa, Artificial Sequence
  Description of Artificial Sequence: Synthetic peptide
DDNDRPS

SEQ ID NO: 18254 - protein, 7 aa, Artificial Sequence
  Description of Artificial Sequence: Synthetic peptide
DDNDRPS

SEQ ID NO: 18255 - protein, 7 aa, Artificial Sequence
  Description of Artificial Sequence: Synthetic peptide
STSNKHS

SEQ ID NO: 18256 - protein, 7 aa, Artificial Sequence
  Description of Artificial Sequence: Synthetic peptide
GTKFLAP

SEQ ID NO: 18257 - protein, 7 aa, Artificial Sequence
  Description of Artificial Sequence: Synthetic peptide
GTKFLAP

SEQ ID NO: 18258 - protein, 7 aa, Artificial Sequence
  Description of Artificial Sequence: Synthetic peptide
GTKFLAP

SEQ ID NO: 18259 - protein, 17 aa, Artificial Sequence
  Description of Artificial Sequence: Synthetic peptide
AISGSGGSTYYADSVKG

SEQ ID NO: 18260 - protein, 17 aa, Artificial Sequence
  Description of Artificial Sequence: Synthetic peptide
AISGSGGGTYYAASVKG

SEQ ID NO: 18261 - protein, 17 aa, Artificial Sequence
  Description of Artificial Sequence: Synthetic peptide
SISGSGGGTYYAASVKG

SEQ ID NO: 18262 - protein, 19 aa, Artificial Sequence
  Description of Artificial Sequence: Synthetic peptide
RIRSKANSYATAYAASVKG

SEQ ID NO: 18263 - protein, 19 aa, Artificial Sequence
  Description of Artificial Sequence: Synthetic peptide
RIRSKYNNYATYYADAVKD

SEQ ID NO: 18264 - protein, 19 aa, Artificial Sequence
  Description of Artificial Sequence: Synthetic peptide
RIRSKYNNYATYYADAVKD

SEQ ID NO: 18265 - protein, 19 aa, Artificial Sequence
  Description of Artificial Sequence: Synthetic peptide
RIRSKYNNYATYYADAVKD

SEQ ID NO: 18266 - protein, 19 aa, Artificial Sequence
  Description of Artificial Sequence: Synthetic peptide
RIKSKTDGGTTDYAAPVKG

SEQ ID NO: 18267 - protein, 19 aa, Artificial Sequence
  Description of Artificial Sequence: Synthetic peptide
RIRSRSYGGTTDYAAPVKG

SEQ ID NO: 18268 - protein, 32 aa, Artificial Sequence; identical to SEQ ID NO: 1346
  Description of Artificial Sequence: Synthetic polypeptide

SEQ ID NO: 18269 - protein, 32 aa, Artificial Sequence; identical to SEQ ID NO: 1346
  Description of Artificial Sequence: Synthetic polypeptide

SEQ ID NO: 18270 - protein, 32 aa, Artificial Sequence; identical to SEQ ID NO: 1374
  Description of Artificial Sequence: Synthetic polypeptide

SEQ ID NO: 18271 - protein, 32 aa, Artificial Sequence; identical to SEQ ID NO: 1374
  Description of Artificial Sequence: Synthetic polypeptide

SEQ ID NO: 18272 - protein, 32 aa, Artificial Sequence; identical to SEQ ID NO: 1374
  Description of Artificial Sequence: Synthetic polypeptide

SEQ ID NO: 18273 - protein, 32 aa, Artificial Sequence; identical to SEQ ID NO: 1385
  Description of Artificial Sequence: Synthetic polypeptide

SEQ ID NO: 18274 - protein, 32 aa, Artificial Sequence; identical to SEQ ID NO: 17249
  Description of Artificial Sequence: Synthetic polypeptide

SEQ ID NO: 18275 - protein, 32 aa, Artificial Sequence; identical to SEQ ID NO: 17249
  Description of Artificial Sequence: Synthetic polypeptide

SEQ ID NO: 18276 - protein, 32 aa, Artificial Sequence; identical to SEQ ID NO: 17249
  Description of Artificial Sequence: Synthetic polypeptide

SEQ ID NO: 18277 - protein, 32 aa, Artificial Sequence; identical to SEQ ID NO: 1427
  Description of Artificial Sequence: Synthetic polypeptide

SEQ ID NO: 18278 - protein, 32 aa, Artificial Sequence; identical to SEQ ID NO: 1434
  Description of Artificial Sequence: Synthetic polypeptide

SEQ ID NO: 18279 - protein, 32 aa, Artificial Sequence; identical to SEQ ID NO: 1428
  Description of Artificial Sequence: Synthetic polypeptide

SEQ ID NO: 18280 - protein, 32 aa, Artificial Sequence; identical to SEQ ID NO: 1441
  Description of Artificial Sequence: Synthetic polypeptide

SEQ ID NO: 18281 - protein, 32 aa, Artificial Sequence; identical to SEQ ID NO: 17251
  Description of Artificial Sequence: Synthetic polypeptide

SEQ ID NO: 18282 - protein, 32 aa, Artificial Sequence; identical to SEQ ID NO: 17251
  Description of Artificial Sequence: Synthetic polypeptide

SEQ ID NO: 18283 - protein, 32 aa, Artificial Sequence; identical to SEQ ID NO: 17251
  Description of Artificial Sequence: Synthetic polypeptide

SEQ ID NO: 18284 - protein, 32 aa, Artificial Sequence; identical to SEQ ID NO: 1480
  Description of Artificial Sequence: Synthetic polypeptide

SEQ ID NO: 18285 - protein, 32 aa, Artificial Sequence; identical to SEQ ID NO: 1481
  Description of Artificial Sequence: Synthetic polypeptide

SEQ ID NO: 18286 - protein, 9 aa, Artificial Sequence
  Description of Artificial Sequence: Synthetic peptide
QQSYSTPWT

SEQ ID NO: 18287 - protein, 9 aa, Artificial Sequence
  Description of Artificial Sequence: Synthetic peptide
QQTYSMPFT

SEQ ID NO: 18288 - protein, 11 aa, Artificial Sequence
  Description of Artificial Sequence: Synthetic peptide
QVWDSSSDHVV

SEQ ID NO: 18289 - protein, 11 aa, Artificial Sequence
  Description of Artificial Sequence: Synthetic peptide
QVWDYSGQRQV

SEQ ID NO: 18290 - protein, 11 aa, Artificial Sequence
  Description of Artificial Sequence: Synthetic peptide
QVWDYSPLRHV

SEQ ID NO: 18291 - protein, 10 aa, Artificial Sequence
  Description of Artificial Sequence: Synthetic peptide
LLYYGGAQWV

SEQ ID NO: 18292 - protein, 9 aa, Artificial Sequence
  Description of Artificial Sequence: Synthetic peptide
VLWYSNRWV

SEQ ID NO: 18293 - protein, 9 aa, Artificial Sequence
  Description of Artificial Sequence: Synthetic peptide
VLWYSNRWV

SEQ ID NO: 18294 - protein, 9 aa, Artificial Sequence
  Description of Artificial Sequence: Synthetic peptide
VLWYSNRWV

SEQ ID NO: 18295 - protein, 10 aa, Artificial Sequence
  Description of Artificial Sequence: Synthetic peptide
GIAVAGYFDY

SEQ ID NO: 18296 - protein, 10 aa, Artificial Sequence
  Description of Artificial Sequence: Synthetic peptide
GKGVHLGFDY

SEQ ID NO: 18297 - protein, 10 aa, Artificial Sequence
  Description of Artificial Sequence: Synthetic peptide
GKGVHLGFDY

SEQ ID NO: 18298 - protein, 13 aa, Artificial Sequence
  Description of Artificial Sequence: Synthetic peptide
AYCGGDCYSYFDY

SEQ ID NO: 18299 - protein, 14 aa, Artificial Sequence
  Description of Artificial Sequence: Synthetic peptide
AGNFGSSYISYWAY

SEQ ID NO: 18300 - protein, 14 aa, Artificial Sequence
  Description of Artificial Sequence: Synthetic peptide
AGNFGSSYISYWAY

SEQ ID NO: 18301 - protein, 14 aa, Artificial Sequence
  Description of Artificial Sequence: Synthetic peptide
AGNFGSSYISYWAY

SEQ ID NO: 18302 - protein, 19 aa, Artificial Sequence
  Description of Artificial Sequence: Synthetic peptide
YYYGSGSYYNYYYYYGMDV

SEQ ID NO: 18303 - protein, 16 aa, Artificial Sequence
  Description of Artificial Sequence: Synthetic peptide
PSYSGSYYNYFSVMDV

SEQ ID NO: 18304 - protein, 10 aa, Artificial Sequence
  Description of Artificial Sequence: Synthetic peptide
FGQGTKVEIK

SEQ ID NO: 18305 - protein, 10 aa, Artificial Sequence
  Description of Artificial Sequence: Synthetic peptide
FGCGTKVEIK

SEQ ID NO: 18306 - protein, 10 aa, Artificial Sequence
  Description of Artificial Sequence: Synthetic peptide
FGGGTKLTVL

SEQ ID NO: 18307 - protein, 10 aa, Artificial Sequence
  Description of Artificial Sequence: Synthetic peptide
FGCGTKLTVL

SEQ ID NO: 18308 - protein, 10 aa, Artificial Sequence
  Description of Artificial Sequence: Synthetic peptide
FGCGTKLTVL

SEQ ID NO: 18309 - protein, 10 aa, Artificial Sequence
  Description of Artificial Sequence: Synthetic peptide
FGGGTKLTVL

SEQ ID NO: 18310 - protein, 10 aa, Artificial Sequence
  Description of Artificial Sequence: Synthetic peptide
FGSGTKLTVL

SEQ ID NO: 18311 - protein, 10 aa, Artificial Sequence
  Description of Artificial Sequence: Synthetic peptide
FGSGTKLTVL

SEQ ID NO: 18312 - protein, 10 aa, Artificial Sequence
  Description of Artificial Sequence: Synthetic peptide
FGSGTKLTVL

SEQ ID NO: 18313 - protein, 11 aa, Artificial Sequence
  Description of Artificial Sequence: Synthetic peptide
WGQGTLVTVSS

SEQ ID NO: 18314 - protein, 11 aa, Artificial Sequence
  Description of Artificial Sequence: Synthetic peptide
WGQGTLVTVSS

SEQ ID NO: 18315 - protein, 11 aa, Artificial Sequence
  Description of Artificial Sequence: Synthetic peptide
WGQGTLVTVSS

SEQ ID NO: 18316 - protein, 11 aa, Artificial Sequence
  Description of Artificial Sequence: Synthetic peptide
WGQGTLVTVSS

SEQ ID NO: 18317 - protein, 11 aa, Artificial Sequence
  Description of Artificial Sequence: Synthetic peptide
WGQGTLVTVSS

SEQ ID NO: 18318 - protein, 11 aa, Artificial Sequence
  Description of Artificial Sequence: Synthetic peptide
WGQGTLVTVSS

SEQ ID NO: 18319 - protein, 11 aa, Artificial Sequence
  Description of Artificial Sequence: Synthetic peptide
WGQGTLVTVSS

SEQ ID NO: 18320 - protein, 11 aa, Artificial Sequence
  Description of Artificial Sequence: Synthetic peptide
WGQGTTVTVSS

SEQ ID NO: 18321 - protein, 11 aa, Artificial Sequence
  Description of Artificial Sequence: Synthetic peptide
WGQGTTVTVSS

SEQ ID NO: 18322 - protein, 23 aa, Artificial Sequence
  Description of Artificial Sequence: Synthetic peptide
DIQMTQSPSSLSASVGDRVTITC

SEQ ID NO: 18323 - protein, 23 aa, Artificial Sequence
  Description of Artificial Sequence: Synthetic peptide
DIQMTQSPSSLSASVGDRVTITC

SEQ ID NO: 18324 - protein, 22 aa, Artificial Sequence
  Description of Artificial Sequence: Synthetic peptide
SYVLTQPPSVSVAPGKTARITC

SEQ ID NO: 18325 - protein, 22 aa, Artificial Sequence
  Description of Artificial Sequence: Synthetic peptide
SYVLTQPPSVSVAPGQTARITC

SEQ ID NO: 18326 - protein, 22 aa, Artificial Sequence
  Description of Artificial Sequence: Synthetic peptide
SYVLTQPPSVSVAPGQTARITC

SEQ ID NO: 18327 - protein, 22 aa, Artificial Sequence
  Description of Artificial Sequence: Synthetic peptide
QTVVTQEPSLTVSPGGTVTLTC

SEQ ID NO: 18328 - protein, 22 aa, Artificial Sequence
  Description of Artificial Sequence: Synthetic peptide
QTVVTQEPSLTVSPGGTVTITC

SEQ ID NO: 18329 - protein, 22 aa, Artificial Sequence
  Description of Artificial Sequence: Synthetic peptide
QTVVTQEPSLTVSPGGTVTITC

SEQ ID NO: 18330 - protein, 22 aa, Artificial Sequence
  Description of Artificial Sequence: Synthetic peptide
QTVVTQEPSLTVSPGGTVTITC

SEQ ID NO: 18331 - protein, 30 aa, Artificial Sequence; identical to SEQ ID NO: 779
  Description of Artificial Sequence: Synthetic polypeptide

SEQ ID NO: 18332 - protein, 30 aa, Artificial Sequence; identical to SEQ ID NO: 779
  Description of Artificial Sequence: Synthetic polypeptide

SEQ ID NO: 18333 - protein, 30 aa, Artificial Sequence; identical to SEQ ID NO: 779
  Description of Artificial Sequence: Synthetic polypeptide

SEQ ID NO: 18334 - protein, 30 aa, Artificial Sequence; identical to SEQ ID NO: 793
  Description of Artificial Sequence: Synthetic polypeptide

SEQ ID NO: 18335 - protein, 30 aa, Artificial Sequence; identical to SEQ ID NO: 794
  Description of Artificial Sequence: Synthetic polypeptide

SEQ ID NO: 18336 - protein, 30 aa, Artificial Sequence; identical to SEQ ID NO: 794
  Description of Artificial Sequence: Synthetic polypeptide

SEQ ID NO: 18337 - protein, 30 aa, Artificial Sequence; identical to SEQ ID NO: 794
  Description of Artificial Sequence: Synthetic polypeptide

SEQ ID NO: 18338 - protein, 30 aa, Artificial Sequence; identical to SEQ ID NO: 832
  Description of Artificial Sequence: Synthetic polypeptide

SEQ ID NO: 18339 - protein, 30 aa, Artificial Sequence; identical to SEQ ID NO: 833
  Description of Artificial Sequence: Synthetic polypeptide

SEQ ID NO: 18340 - protein, 11 aa, Artificial Sequence
  Description of Artificial Sequence: Synthetic peptide
RASQSISSYLN

SEQ ID NO: 18341 - protein, 11 aa, Artificial Sequence
  Description of Artificial Sequence: Synthetic peptide
RTSQSISSYLN

SEQ ID NO: 18342 - protein, 11 aa, Artificial Sequence
  Description of Artificial Sequence: Synthetic peptide
GGNNIGSKSVH

SEQ ID NO: 18343 - protein, 11 aa, Artificial Sequence
  Description of Artificial Sequence: Synthetic peptide
GGNNIGSKSVH

SEQ ID NO: 18344 - protein, 11 aa, Artificial Sequence
  Description of Artificial Sequence: Synthetic peptide
GGNNIGSKSVH

SEQ ID NO: 18345 - protein, 14 aa, Artificial Sequence
  Description of Artificial Sequence: Synthetic peptide
ASSTGAVTSGYYPN

SEQ ID NO: 18346 - protein, 14 aa, Artificial Sequence
  Description of Artificial Sequence: Synthetic peptide
GSSTGAVTSGNYPN

SEQ ID NO: 18347 - protein, 14 aa, Artificial Sequence
  Description of Artificial Sequence: Synthetic peptide
GSSTGAVTSGNYPN

SEQ ID NO: 18348 - protein, 14 aa, Artificial Sequence
  Description of Artificial Sequence: Synthetic peptide
GSSTGAVTSGNYPN

SEQ ID NO: 18349 - protein, 5 aa, Artificial Sequence
  Description of Artificial Sequence: Synthetic peptide
SYAMS

SEQ ID NO: 18350 - protein, 5 aa, Artificial Sequence
  Description of Artificial Sequence: Synthetic peptide
SYAMS

SEQ ID NO: 18351 - protein, 5 aa, Artificial Sequence
  Description of Artificial Sequence: Synthetic peptide
SHAMS

SEQ ID NO: 18352 - protein, 5 aa, Artificial Sequence
  Description of Artificial Sequence: Synthetic peptide
GSAMH

SEQ ID NO: 18353 - protein, 5 aa, Artificial Sequence
  Description of Artificial Sequence: Synthetic peptide
KYAIN

SEQ ID NO: 18354 - protein, 5 aa, Artificial Sequence
  Description of Artificial Sequence: Synthetic peptide
KYAIN

SEQ ID NO: 18355 - protein, 5 aa, Artificial Sequence
  Description of Artificial Sequence: Synthetic peptide
KYAIN

SEQ ID NO: 18356 - protein, 5 aa, Artificial Sequence
  Description of Artificial Sequence: Synthetic peptide
NAWMS

SEQ ID NO: 18357 - protein, 5 aa, Artificial Sequence
  Description of Artificial Sequence: Synthetic peptide
NAWMS

SEQ ID NO: 18358 - protein, 15 aa, Artificial Sequence
  Description of Artificial Sequence: Synthetic peptide
WYQQKPGKAPKLLIY

SEQ ID NO: 18359 - protein, 15 aa, Artificial Sequence
  Description of Artificial Sequence: Synthetic peptide
WYQQKPGRAPKLLIF

SEQ ID NO: 18360 - protein, 15 aa, Artificial Sequence
  Description of Artificial Sequence: Synthetic peptide
WYQQKPGQAPVLVIY

SEQ ID NO: 18361 - protein, 15 aa, Artificial Sequence
  Description of Artificial Sequence: Synthetic peptide
WYQQKPGQAPVMVVY

SEQ ID NO: 18362 - protein, 15 aa, Artificial Sequence
  Description of Artificial Sequence: Synthetic peptide
WYQQKPGQAPVMVVY

SEQ ID NO: 18363 - protein, 15 aa, Artificial Sequence
  Description of Artificial Sequence: Synthetic peptide
WFQQKPGQAPRALIY

SEQ ID NO: 18364 - protein, 15 aa, Artificial Sequence
  Description of Artificial Sequence: Synthetic peptide
WVQKKPGQAPRGLIG

SEQ ID NO: 18365 - protein, 15 aa, Artificial Sequence
  Description of Artificial Sequence: Synthetic peptide
WVQKKPGQAPRGLIG

SEQ ID NO: 18366 - protein, 15 aa, Artificial Sequence
  Description of Artificial Sequence: Synthetic peptide
WVQKKPGQAPRGLIG

SEQ ID NO: 18367 - protein, 14 aa, Artificial Sequence
  Description of Artificial Sequence: Synthetic peptide
WVRQAPGKGLEWVS

SEQ ID NO: 18368 - protein, 14 aa, Artificial Sequence
  Description of Artificial Sequence: Synthetic peptide
WVRQAPGKCLEWVS

SEQ ID NO: 18369 - protein, 14 aa, Artificial Sequence
  Description of Artificial Sequence: Synthetic peptide
WVRQAPGKCLEWVS

SEQ ID NO: 18370 - protein, 14 aa, Artificial Sequence
  Description of Artificial Sequence: Synthetic peptide
WVRQASGKGLEWVG

SEQ ID NO: 18371 - protein, 14 aa, Artificial Sequence
  Description of Artificial Sequence: Synthetic peptide
WVRQAPGKGLEWVA

SEQ ID NO: 18372 - protein, 14 aa, Artificial Sequence
  Description of Artificial Sequence: Synthetic peptide
WVRQAPGKGLEWVA

SEQ ID NO: 18373 - protein, 14 aa, Artificial Sequence
  Description of Artificial Sequence: Synthetic peptide
WVRQAPGKGLEWVA

SEQ ID NO: 18374 - protein, 14 aa, Artificial Sequence
  Description of Artificial Sequence: Synthetic peptide
WVRQAPGKGLEWVG

SEQ ID NO: 18375 - protein, 14 aa, Artificial Sequence
  Description of Artificial Sequence: Synthetic peptide
WVRQAPGKCLEWVG

SEQ ID NO: 18376 - protein, 7 aa, Artificial Sequence
  Description of Artificial Sequence: Synthetic peptide
AASSLQS

SEQ ID NO: 18377 - protein, 7 aa, Artificial Sequence
  Description of Artificial Sequence: Synthetic peptide
AASSLQG

SEQ ID NO: 18378 - protein, 7 aa, Artificial Sequence
  Description of Artificial Sequence: Synthetic peptide
YDSDRPS

SEQ ID NO: 18379 - protein, 7 aa, Artificial Sequence
  Description of Artificial Sequence: Synthetic peptide
DDNDRPS

SEQ ID NO: 18380 - protein, 7 aa, Artificial Sequence
  Description of Artificial Sequence: Synthetic peptide
DDNDRPS

SEQ ID NO: 18381 - protein, 7 aa, Artificial Sequence
  Description of Artificial Sequence: Synthetic peptide
STSNKHS

SEQ ID NO: 18382 - protein, 7 aa, Artificial Sequence
  Description of Artificial Sequence: Synthetic peptide
GTKFLAP

SEQ ID NO: 18383 - protein, 7 aa, Artificial Sequence
  Description of Artificial Sequence: Synthetic peptide
GTKFLAP

SEQ ID NO: 18384 - protein, 7 aa, Artificial Sequence
  Description of Artificial Sequence: Synthetic peptide
GTKFLAP

SEQ ID NO: 18385 - protein, 17 aa, Artificial Sequence
  Description of Artificial Sequence: Synthetic peptide
AISGSGGSTYYADSVKG

SEQ ID NO: 18386 - protein, 17 aa, Artificial Sequence
  Description of Artificial Sequence: Synthetic peptide
AISGSGGGTYYAASVKG

SEQ ID NO: 18387 - protein, 17 aa, Artificial Sequence
  Description of Artificial Sequence: Synthetic peptide
SISGSGGGTYYAASVKG

SEQ ID NO: 18388 - protein, 19 aa, Artificial Sequence
  Description of Artificial Sequence: Synthetic peptide
RIRSKANSYATAYAASVKG

SEQ ID NO: 18389 - protein, 19 aa, Artificial Sequence
  Description of Artificial Sequence: Synthetic peptide
RIRSKYNNYATYYADAVKD

SEQ ID NO: 18390 - protein, 19 aa, Artificial Sequence
  Description of Artificial Sequence: Synthetic peptide
RIRSKYNNYATYYADAVKD

SEQ ID NO: 18391 - protein, 19 aa, Artificial Sequence
  Description of Artificial Sequence: Synthetic peptide
RIRSKYNNYATYYADAVKD

SEQ ID NO: 18392 - protein, 19 aa, Artificial Sequence
  Description of Artificial Sequence: Synthetic peptide
RIKSKTDGGTTDYAAPVKG

SEQ ID NO: 18393 - protein, 19 aa, Artificial Sequence
  Description of Artificial Sequence: Synthetic peptide
RIRSRSYGGTTDYAAPVKG

SEQ ID NO: 18394 - protein, 32 aa, Artificial Sequence; identical to SEQ ID NO: 1346
  Description of Artificial Sequence: Synthetic polypeptide

SEQ ID NO: 18395 - protein, 32 aa, Artificial Sequence; identical to SEQ ID NO: 1346
  Description of Artificial Sequence: Synthetic polypeptide

SEQ ID NO: 18396 - protein, 32 aa, Artificial Sequence; identical to SEQ ID NO: 1374
  Description of Artificial Sequence: Synthetic polypeptide

SEQ ID NO: 18397 - protein, 32 aa, Artificial Sequence; identical to SEQ ID NO: 1374
  Description of Artificial Sequence: Synthetic polypeptide

SEQ ID NO: 18398 - protein, 32 aa, Artificial Sequence; identical to SEQ ID NO: 1374
  Description of Artificial Sequence: Synthetic polypeptide

SEQ ID NO: 18399 - protein, 32 aa, Artificial Sequence; identical to SEQ ID NO: 1385
  Description of Artificial Sequence: Synthetic polypeptide

SEQ ID NO: 18400 - protein, 32 aa, Artificial Sequence; identical to SEQ ID NO: 17249
  Description of Artificial Sequence: Synthetic polypeptide

SEQ ID NO: 18401 - protein, 32 aa, Artificial Sequence; identical to SEQ ID NO: 17249
  Description of Artificial Sequence: Synthetic polypeptide

SEQ ID NO: 18402 - protein, 32 aa, Artificial Sequence; identical to SEQ ID NO: 17249
  Description of Artificial Sequence: Synthetic polypeptide

SEQ ID NO: 18403 - protein, 32 aa, Artificial Sequence; identical to SEQ ID NO: 1427
  Description of Artificial Sequence: Synthetic polypeptide

SEQ ID NO: 18404 - protein, 32 aa, Artificial Sequence; identical to SEQ ID NO: 1434
  Description of Artificial Sequence: Synthetic polypeptide

SEQ ID NO: 18405 - protein, 32 aa, Artificial Sequence; identical to SEQ ID NO: 1428
  Description of Artificial Sequence: Synthetic polypeptide

SEQ ID NO: 18406 - protein, 32 aa, Artificial Sequence; identical to SEQ ID NO: 1441
  Description of Artificial Sequence: Synthetic polypeptide

SEQ ID NO: 18407 - protein, 32 aa, Artificial Sequence; identical to SEQ ID NO: 17251
  Description of Artificial Sequence: Synthetic polypeptide

SEQ ID NO: 18408 - protein, 32 aa, Artificial Sequence; identical to SEQ ID NO: 17251
  Description of Artificial Sequence: Synthetic polypeptide

SEQ ID NO: 18409 - protein, 32 aa, Artificial Sequence; identical to SEQ ID NO: 17251
  Description of Artificial Sequence: Synthetic polypeptide

SEQ ID NO: 18410 - protein, 32 aa, Artificial Sequence; identical to SEQ ID NO: 1480
  Description of Artificial Sequence: Synthetic polypeptide

SEQ ID NO: 18411 - protein, 32 aa, Artificial Sequence; identical to SEQ ID NO: 1481
  Description of Artificial Sequence: Synthetic polypeptide

SEQ ID NO: 18412 - protein, 9 aa, Artificial Sequence
  Description of Artificial Sequence: Synthetic peptide
QQSYSTPWT

SEQ ID NO: 18413 - protein, 9 aa, Artificial Sequence
  Description of Artificial Sequence: Synthetic peptide
QQTYSMPFT

SEQ ID NO: 18414 - protein, 11 aa, Artificial Sequence
  Description of Artificial Sequence: Synthetic peptide
QVWDSSSDHVV

SEQ ID NO: 18415 - protein, 11 aa, Artificial Sequence
  Description of Artificial Sequence: Synthetic peptide
QVWDYSGQRQV

SEQ ID NO: 18416 - protein, 11 aa, Artificial Sequence
  Description of Artificial Sequence: Synthetic peptide
QVWDYSPLRHV

SEQ ID NO: 18417 - protein, 10 aa, Artificial Sequence
  Description of Artificial Sequence: Synthetic peptide
LLYYGGAQWV

SEQ ID NO: 18418 - protein, 9 aa, Artificial Sequence
  Description of Artificial Sequence: Synthetic peptide
VLWYSNRWV

SEQ ID NO: 18419 - protein, 9 aa, Artificial Sequence
  Description of Artificial Sequence: Synthetic peptide
VLWYSNRWV

SEQ ID NO: 18420 - protein, 9 aa, Artificial Sequence
  Description of Artificial Sequence: Synthetic peptide
VLWYSNRWV

SEQ ID NO: 18421 - protein, 10 aa, Artificial Sequence
  Description of Artificial Sequence: Synthetic peptide
GIAVAGYFDY

SEQ ID NO: 18422 - protein, 10 aa, Artificial Sequence
  Description of Artificial Sequence: Synthetic peptide
GKGVHLGFDY

SEQ ID NO: 18423 - protein, 10 aa, Artificial Sequence
  Description of Artificial Sequence: Synthetic peptide
GKGVHLGFDY

SEQ ID NO: 18424 - protein, 13 aa, Artificial Sequence
  Description of Artificial Sequence: Synthetic peptide
AYCGGDCYSYFDY

SEQ ID NO: 18425 - protein, 14 aa, Artificial Sequence
  Description of Artificial Sequence: Synthetic peptide
AGNFGSSYISYWAY

SEQ ID NO: 18426 - protein, 14 aa, Artificial Sequence
  Description of Artificial Sequence: Synthetic peptide
AGNFGSSYISYWAY

SEQ ID NO: 18427 - protein, 14 aa, Artificial Sequence
  Description of Artificial Sequence: Synthetic peptide
AGNFGSSYISYWAY

SEQ ID NO: 18428 - protein, 19 aa, Artificial Sequence
  Description of Artificial Sequence: Synthetic peptide
YYYGSGSYYNYYYYYGMDV

SEQ ID NO: 18429 - protein, 16 aa, Artificial Sequence
  Description of Artificial Sequence: Synthetic peptide
PSYSGSYYNYFSVMDV

SEQ ID NO: 18430 - protein, 10 aa, Artificial Sequence
  Description of Artificial Sequence: Synthetic peptide
FGQGTKVEIK

SEQ ID NO: 18431 - protein, 10 aa, Artificial Sequence
  Description of Artificial Sequence: Synthetic peptide
FGCGTKVEIK

SEQ ID NO: 18432 - protein, 10 aa, Artificial Sequence
  Description of Artificial Sequence: Synthetic peptide
FGGGTKLTVL

SEQ ID NO: 18433 - protein, 10 aa, Artificial Sequence
  Description of Artificial Sequence: Synthetic peptide
FGCGTKLTVL

SEQ ID NO: 18434 - protein, 10 aa, Artificial Sequence
  Description of Artificial Sequence: Synthetic peptide
FGCGTKLTVL

SEQ ID NO: 18435 - protein, 10 aa, Artificial Sequence
  Description of Artificial Sequence: Synthetic peptide
FGGGTKLTVL

SEQ ID NO: 18436 - protein, 10 aa, Artificial Sequence
  Description of Artificial Sequence: Synthetic peptide
FGSGTKLTVL

SEQ ID NO: 18437 - protein, 10 aa, Artificial Sequence
  Description of Artificial Sequence: Synthetic peptide
FGSGTKLTVL

SEQ ID NO: 18438 - protein, 10 aa, Artificial Sequence
  Description of Artificial Sequence: Synthetic peptide
FGSGTKLTVL

SEQ ID NO: 18439 - protein, 11 aa, Artificial Sequence
  Description of Artificial Sequence: Synthetic peptide
WGQGTLVTVSS

SEQ ID NO: 18440 - protein, 11 aa, Artificial Sequence
  Description of Artificial Sequence: Synthetic peptide
WGQGTLVTVSS

SEQ ID NO: 18441 - protein, 11 aa, Artificial Sequence
  Description of Artificial Sequence: Synthetic peptide
WGQGTLVTVSS

SEQ ID NO: 18442 - protein, 11 aa, Artificial Sequence
  Description of Artificial Sequence: Synthetic peptide
WGQGTLVTVSS

SEQ ID NO: 18443 - protein, 11 aa, Artificial Sequence
  Description of Artificial Sequence: Synthetic peptide
WGQGTLVTVSS

SEQ ID NO: 18444 - protein, 11 aa, Artificial Sequence
  Description of Artificial Sequence: Synthetic peptide
WGQGTLVTVSS

SEQ ID NO: 18445 - protein, 11 aa, Artificial Sequence
  Description of Artificial Sequence: Synthetic peptide
WGQGTLVTVSS

SEQ ID NO: 18446 - protein, 11 aa, Artificial Sequence
  Description of Artificial Sequence: Synthetic peptide
WGQGTTVTVSS

SEQ ID NO: 18447 - protein, 11 aa, Artificial Sequence
  Description of Artificial Sequence: Synthetic peptide
WGQGTTVTVSS

SEQ ID NO: 18448 - protein, 5 aa, Artificial Sequence
  Description of Artificial Sequence: Synthetic peptide
  See specification as filed for detailed description of substitutions and preferred embodiments
GGGGS

SEQ ID NO: 18449 - protein, 25 aa, Artificial Sequence
  Description of Artificial Sequence: Synthetic peptide
  See specification as filed for detailed description of substitutions and preferred embodiments
GGGGSGGGGSGGGGSGGGGSGGGGS

SEQ ID NO: 18450 - protein, 10 aa, Artificial Sequence
  Description of Artificial Sequence: Synthetic peptide
  See specification as filed for detailed description of substitutions and preferred embodiments
GGGGSGGGGS

SEQ ID NO: 18451 - protein, 6 aa, Artificial Sequence
  Description of Artificial Sequence: Synthetic peptide
  SITE (1)..(6): This sequence may encompass 5-6 residues
HHHHHH

SEQ ID NO: 18452 - protein, 5 aa, Homo sapiens
QDGNE

SEQ ID NO: 18453 - protein, 10 aa, Homo sapiens
GYVDGEEHSV

SEQ ID NO: 18454 - protein, 277 aa, Homo sapiens [sequence omitted]

SEQ ID NO: 18455 - protein, 100 aa, Homo sapiens [sequence omitted]

SEQ ID NO: 18456 - protein, 243 aa, Artificial Sequence
  Description of Artificial Sequence: Synthetic polypeptide
EVQLLESGGGLVQPGGSLRLSCAASGFTFSSHAMSWVRQAPGKCLEWVSTISGSGGGTYYAASVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGCGTKLTVLG

SEQ ID NO: 18457 - protein, 243 aa, Artificial Sequence
  Description of Artificial Sequence: Synthetic polypeptide
EVQLLESGGGLVQPGGSLRLSCAASGFTFSSHAMSWVRQAPGKCLEWVSTISGSGGGTYYADSVKGRFTISRDNSKNTLYLQMNSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNFGNTATLIISRVEAGDEADYYCQVWDYRTLDWVFGCGTKLTVLG

SEQ ID NO: 18458 - protein, 245 aa, Artificial Sequence
  Description of Artificial Sequence: Synthetic polypeptide
MKEVQLLESGGGLVQPGGSLRLSCAASGFTFSSYAMSWVRQAPGKCLEWVSAISGSGGGTYYAASVKGRFTISRDNSKNTLYLQMSSLRAEDTAVYYCATGKGVHLGFDYWGQGTLVTVSSGGGGSGGGGSGGGGSSYVLTQPPSVSVAPGQTARITCGGNNIGSKSVHWYQQKPGQAPVMVVYDDNDRPSGIPERFSGSNSGNTATLTISRVEAGDEADYYCQVWDYSGQRQVFGCGTKLTVLG

SEQ ID NO: 18459 - protein, 241 aa, Artificial Sequence
  Description of Artificial Sequence: Synthetic polypeptide
EVQLVESGGGLVQPGGSLRLSCAASGFTFSNAWMSWVRQAPGKGLEWVGRIRSRSYGGTTDYAAPVKGRFTISRDDSKNTLFLQMNSLKTEDTAVYYCTTPSYSGSYYNYFSVMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDHHHHHHHHHH

SEQ ID NO: 18460 - protein, 214 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 18461 - protein, 10 aa, Unknown
  Description of Unknown: KEA peptide
GVIDGHIYAV

SEQ ID NO: 18462 - protein, 10 aa, Unknown
  Description of Unknown: MB peptide
GLSDGEWQLV

SEQ ID NO: 18463 - protein, 10 aa, Unknown
  Description of Unknown: ADF peptide
GVMAGDIYSV

SEQ ID NO: 18464 - protein, 10 aa, Unknown
  Description of Unknown: DPYSL4 peptide
GLYDGPMHEV

SEQ ID NO: 18465 - protein, 10 aa, Unknown
  Description of Unknown: CNPD2 peptide
GVYGGSVHEA

SEQ ID NO: 18466 - protein, 10 aa, Unknown
  Description of Unknown: MYOF peptide
FVYDEPGHAV

SEQ ID NO: 18467 - protein, 10 aa, Unknown
  Description of Unknown: COX14 peptide
TVYGGYLCSV

SEQ ID NO: 18468 - protein, 10 aa, Unknown
  Description of Unknown: STXBP5 peptide
YTYDEAIHSV

SEQ ID NO: 18469 - protein, 10 aa, Unknown
  Description of Unknown: SLK peptide
FIVDGVEVSV

SEQ ID NO: 18470 - protein, 118 aa, Artificial Sequence
  Description of Artificial Sequence: Synthetic polypeptide
EVQLLESGGGLVQPGGSLRLSCAASGFTFSSHAMSWVRQAPGKCLEWVSTISGSGGGTYYAASVKGRFTISRDNSKNTLYLQMNSLRAEDTAVYYCATGKGVHLGFDYWGQGTLVTVS

SEQ ID NO: 18471 - protein, 118 aa, Artificial Sequence
  Description of Artificial Sequence: Synthetic polypeptide
EVQLLESGGGLVQPGGSLRLSCAASGFTFSSHAMSWVRQAPGKCLEWVSTISGSGGGTYYADSVKGRFTISRDNSKNTLYLQMNSLRAEDTAVYYCATGKGVHLGFDYWGQGTLVTVS

SEQ ID NO: 18472 - protein, 118 aa, Artificial Sequence
  Description of Artificial Sequence: Synthetic polypeptide
EVQLLESGGGLVQPGGSLRLSCAASGFTFSSYAMSWVRQAPGKCLEWVSAISGSGGGTYYAASVKGRFTISRDNSKNTLYLQMSSLRAEDTAVYYCATGKGVHLGFDYWGQGTLVTVS

SEQ ID NO: 18473 - protein, 117 aa, Artificial Sequence
  Description of Artificial Sequence: Synthetic polypeptide
LVQPGGSLRLSCAASGFTFSNAWMSWVRQAPGKCLEWVGRIRSRSYGGTTDYAAPVKGRFTISRDDSKNTLFLQMNSLKTEDTAVYYCTTPSYSGSYYNYFSVMDVWGQGTTVTVSS

SEQ ID NO: 18474 - protein, 117 aa, Artificial Sequence
  Description of Artificial Sequence: Synthetic polypeptide
LVQPGGSLRLSCAASGFTFSNAWMSWVRQAPGKCLEWVGRIKSKTYGGTTDYAAPVKGRFTISRDDSKNTLYLQMNSLKTEDTAVYYCTTPSYSGSYYNYFSVMDVWGQGTTVTVSS

SEQ ID NO: 18475 - protein, 117 aa, Artificial Sequence
  Description of Artificial Sequence: Synthetic polypeptide
LVQPGGSLRLSCAASGFTFSNAWMSWVRQAPGKCLEWVGRIKSKTYGGTTDYAAPVKGRFTISRDDSKNTLFLQMNSLKTEDTAVYYCTTPSYSGSYYNYFSVMDVWGQGTTVTVSS

SEQ ID NO: 18476 - protein, 108 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQTYSMPFTFGCGTKVEIKS

SEQ ID NO: 18477 - protein, 108 aa, Artificial Sequence
  Description of Artificial Sequence: Synthetic polypeptide
ELQMTQSPSSLSASVGDRVTITCRTSQSISSYLNWFQQKPGKAPKLLIFAASSLQSGVPSRFSGSGSGTDFTLTISSLQPEDFATYYCQQSYSSPFTFGCGTKVEIKS

SEQ ID NO: 18478 - protein, 108 aa, Artificial Sequence
  Description of Artificial Sequence: Synthetic polypeptide
DIQMTQSPSSLSASVGDRVTITCRTSQSISSYLNWYQQKPGRAPKLLIFAASSLQGGVPSRFSGSGSGTDFTLTISSLQPEDFATYYCQQSYSSPFTFGCGTKVEIKS
